(12) United States Patent
Reed et al.

(10) Patent No.: US 11,312,944 B2
(45) Date of Patent: Apr. 26, 2022

(54) POLYMERIZING ENZYMES FOR SEQUENCING REACTIONS

(71) Applicant: Quantum-Si Incorporated, Guilford, CT (US)

(72) Inventors: Brian Reed, Madison, CT (US); Mohammad Wadud Bhuiya, Olivette, MO (US); Manjula Pandey, Guilford, CT (US); Jeremy Lackey, Guilford, CT (US); Jonathan M. Rothberg, Guilford, CT (US); Thomas Christian, Killingworth, CT (US)

(73) Assignee: Quantum-Si Incorporated, Guilford, CT (US)

( * ) Notice: Subject to any disclaimer, the term of this patent is extended or adjusted under 35 U.S.C. 154(b) by 342 days.

(21) Appl. No.: 15/846,967

(22) Filed: Dec. 19, 2017

(65) Prior Publication Data

US 2018/0208911 A1    Jul. 26, 2018
US 2018/0362941 A9    Dec. 20, 2018

Related U.S. Application Data

(60) Provisional application No. 62/436,410, filed on Dec. 19, 2016.

(51) Int. Cl.
*C12N 9/12*      (2006.01)
*C12N 15/52*     (2006.01)
*C12Q 1/6869*    (2018.01)
*C12P 19/34*     (2006.01)

(52) U.S. Cl.
CPC .......... *C12N 9/1252* (2013.01); *C12N 15/52* (2013.01); *C12P 19/34* (2013.01); *C12Q 1/6869* (2013.01); *C12Y 207/07007* (2013.01); *C07K 2319/00* (2013.01)

(58) Field of Classification Search
None
See application file for complete search history.

(56) References Cited

U.S. PATENT DOCUMENTS

| 5,707,804 A | 1/1998 | Mathies et al. |
| 5,851,840 A | 12/1998 | Sluka et al. |
| 6,153,442 A | 11/2000 | Pirio et al. |
| 6,248,518 B1 | 6/2001 | Parkhurst et al. |

(Continued)

FOREIGN PATENT DOCUMENTS

| DE | 19810879 A1 | 9/1999 |
| JP | 2002-506637 A | 3/2002 |

(Continued)

OTHER PUBLICATIONS

Gen Bank Accession No. KWY14141.1, published Feb. 2, 2016 (Year: 2016).*

(Continued)

*Primary Examiner* — Richard C Ekstrom
(74) *Attorney, Agent, or Firm* — Wolf, Greenfield & Sacks, P.C.

(57) ABSTRACT

Compositions comprising modified recombinant polymerizing enzymes are provided, along with nucleic acid molecules encoding the modified polymerizing enzymes. In some aspects, methods of using such polymerizing enzymes to synthesize a nucleic acid molecule or to sequence a nucleic acid template are provided.

29 Claims, 8 Drawing Sheets

Specification includes a Sequence Listing.

(56) References Cited

U.S. PATENT DOCUMENTS

| | | |
|---|---|---|
| 6,255,083 B1 | 7/2001 | Williams |
| 6,762,048 B2 | 7/2004 | Williams |
| 6,787,308 B2 | 9/2004 | Balasubramanian et al. |
| 6,846,638 B2 | 1/2005 | Shipwash |
| 6,869,764 B2 | 3/2005 | Williams et al. |
| 6,936,702 B2 | 8/2005 | Williams et al. |
| 7,052,847 B2 | 5/2006 | Korlach et al. |
| 7,056,661 B2 | 6/2006 | Korlach et al. |
| 7,229,799 B2 | 6/2007 | Williams |
| 7,361,466 B2 | 4/2008 | Korlach et al. |
| 7,968,702 B2 | 6/2011 | Wegener et al. |
| 8,034,623 B2 | 10/2011 | Oh et al. |
| 8,084,734 B2 | 12/2011 | Vertes et al. |
| 8,153,375 B2 | 4/2012 | Travers et al. |
| 8,192,961 B2 | 6/2012 | Williams |
| 8,252,910 B2 | 8/2012 | Korlach et al. |
| 8,257,954 B2 | 9/2012 | Clark et al. |
| 8,309,330 B2 | 11/2012 | Travers et al. |
| 8,354,252 B2 | 1/2013 | Wegener et al. |
| 8,404,808 B2* | 3/2013 | Salas Falgueras ....... C12N 9/90 530/350 |
| 8,420,366 B2 | 4/2013 | Clark et al. |
| 8,455,193 B2 | 6/2013 | Travers et al. |
| 8,530,154 B2 | 9/2013 | Williams |
| 8,581,179 B2 | 11/2013 | Franzen |
| 8,846,881 B2 | 9/2014 | Korlach et al. |
| 8,906,614 B2 | 12/2014 | Wegener et al. |
| 8,927,212 B2 | 1/2015 | Kong et al. |
| 8,980,584 B2 | 3/2015 | Williams |
| 9,062,091 B2 | 6/2015 | Bjornson et al. |
| 9,404,146 B2 | 8/2016 | Travers et al. |
| 9,435,810 B2 | 9/2016 | Havranek et al. |
| 9,464,107 B2 | 10/2016 | Wegener et al. |
| 9,542,527 B2 | 1/2017 | Travers et al. |
| 9,551,031 B2 | 1/2017 | Korlach et al. |
| 9,551,660 B2 | 1/2017 | Kong et al. |
| 9,566,335 B1 | 2/2017 | Emili et al. |
| 9,582,640 B2 | 2/2017 | Travers et al. |
| 9,600,626 B2 | 3/2017 | Travers et al. |
| 9,678,080 B2 | 6/2017 | Bjornson et al. |
| 9,719,073 B2 | 8/2017 | Emig et al. |
| 9,845,501 B2 | 12/2017 | Williams |
| 9,879,319 B2 | 1/2018 | Korlach et al. |
| 9,910,956 B2 | 3/2018 | Travers et al. |
| 9,957,291 B2 | 5/2018 | Sebo et al. |
| 10,023,605 B2 | 7/2018 | Bjornson et al. |
| 10,066,258 B2 | 9/2018 | Kong et al. |
| 10,150,872 B2 | 12/2018 | Zheng et al. |
| 10,161,002 B2 | 12/2018 | Korlach et al. |
| 10,481,162 B2 | 11/2019 | Emili et al. |
| 10,544,449 B2 | 1/2020 | Shen et al. |
| 10,545,153 B2 | 1/2020 | Marcotte et al. |
| 10,570,445 B2 | 2/2020 | Kong et al. |
| 10,676,788 B2 | 6/2020 | Shen et al. |
| 10,745,750 B2 | 8/2020 | Korlach et al. |
| 10,787,573 B2 | 9/2020 | Zheng et al. |
| 2005/0042633 A1 | 2/2005 | Williams |
| 2005/0266456 A1 | 12/2005 | Williams et al. |
| 2007/0072196 A1 | 3/2007 | Xu et al. |
| 2007/0219367 A1 | 9/2007 | Shchepinov et al. |
| 2009/0263802 A1 | 10/2009 | Drmanac |
| 2010/0009872 A1 | 1/2010 | Eid et al. |
| 2010/0029494 A1 | 2/2010 | Cherkasov et al. |
| 2010/0035254 A1 | 2/2010 | Williams |
| 2011/0003343 A1 | 1/2011 | Nikiforov et al. |
| 2011/0281776 A1 | 11/2011 | Eshoo et al. |
| 2012/0034602 A1 | 2/2012 | Emig et al. |
| 2012/0115188 A1* | 5/2012 | Faurholm ............ C12N 9/1252 435/91.1 |
| 2012/0322692 A1 | 12/2012 | Pham et al. |
| 2013/0217007 A1 | 8/2013 | Kamtekar et al. |
| 2013/0316912 A1 | 11/2013 | Bjornson et al. |
| 2017/0136433 A1 | 5/2017 | Sun et al. |
| 2018/0208911 A1* | 7/2018 | Reed ................... C12N 9/1252 |
| 2018/0211003 A1 | 7/2018 | Travers et al. |
| 2018/0299460 A1 | 10/2018 | Emili |
| 2018/0346507 A1 | 12/2018 | Sebo et al. |
| 2019/0010183 A1 | 1/2019 | Bjornson et al. |
| 2019/0249153 A1 | 8/2019 | Kamtekar et al. |
| 2020/0141944 A1 | 5/2020 | Emili et al. |
| 2020/0148727 A1 | 5/2020 | Tullman et al. |

FOREIGN PATENT DOCUMENTS

| | | |
|---|---|---|
| JP | 2012-507986 A | 4/2012 |
| WO | WO 2005/044836 A2 | 5/2005 |
| WO | WO 2007/070572 A2 | 6/2007 |
| WO | WO 2010/062776 A2 | 6/2010 |
| WO | WO 2010/065322 A1 | 6/2010 |
| WO | WO 2010/115016 A2 | 10/2010 |
| WO | WO 2011/040971 A2 | 4/2011 |
| WO | WO-2011040971 A9 * | 8/2011 ........... C12N 9/1252 |
| WO | WO 2019/040825 A1 | 2/2019 |

OTHER PUBLICATIONS

Invitation to Pay Additional Fees for Application No. PCT/US2017/067427 dated Apr. 26, 2018.
International Search Report and Written Opinion for Application No. PCT/US2017/067427 dated Jun. 25, 2018.
International Preliminary Report on Patentability for Application No. PCT/US2017/067427 dated Jul. 4, 2019 (R0708.70022WO00).
PCT/US2017/067427, April 26, 2018, Invitation to Pay Additional Fees.
PCT/US2017/067427, Jun. 25, 2018, International Search Report and Written Opinion.
PCT/US2017/067427, Jul. 4, 2019, International Preliminary Report on Patentability.
Koushik et al., Cerulean, Venus, and VenusY67C FRET reference standards. Biophys J. Dec. 15, 2006;91(12):L99-L101. doi: 10.1529/biophysj.106.096206. Epub Oct. 13, 2006. PMID: 17040988; PMCID: PMC1779932.
Rodriguez et al., A specific subdomain in phi29 DNA polymerase confers both processivity and strand-displacement capacity. Proc Natl Acad Sci U S A. May 3, 2005;102(18):6407-12. doi: 10.1073/pnas.0500597102. Epub Apr. 21, 2005.
Saito et al., Dual-labeled oligonucleotide probe for sensing adenosine via FRET: a novel alternative to SNPs genotyping. Chem Commun (Camb). Jun. 7, 2007;(21):2133-5. doi: 10.1039/b618465k. Epub Feb. 28, 2007. PMID: 17520113.
Sato et al., Polyproline-rod approach to isolating protein targets of bioactive small molecules: isolation of a new target of indomethacin. J Am Chem Soc. Jan. 31, 2007;129(4):873-80. doi: 10.1021/ja0655643. PMID: 17243824.
Stryer et al., Energy transfer: a spectroscopic ruler. Proc Natl Acad Sci U S A. Aug. 1967;58(2):719-26. doi: 10.1073/pnas.58.2.719. PMID: 5233469; PMCID: PMC335693.
Williams et al., An artificial processivity clamp made with streptavidin facilitates oriented attachment of polymerase-DNA complexes to surfaces. Nucleic Acids Res. Oct. 2008;36(18):e121. doi: 10.1093/nar/gkn531. Epub Aug. 22, 2008. PMID: 18723573; PMCID: PMC2566871.
Perez-Arnaiz et al., Involvement of phage phi29 DNA polymerase and terminal protein subdomains in conferring specificity during initiation of protein-primed DNA replication. Nucleic Acids Res. 2007;35(21):7061-73. doi: 10.1093/nar/gkm749. Epub Oct. 2, 2007.

* cited by examiner

FIG. 5B

POLYMERIZING ENZYMES FOR SEQUENCING REACTIONS

RELATED APPLICATIONS

This application claims priority under 35 U.S.C. § 119(e) to U.S. Provisional Patent Application No. 62/436,410, filed Dec. 19, 2016, which is hereby incorporated by reference in its entirety.

FIELD OF THE APPLICATION

The present application is directed generally to methods and compositions for sequencing analysis of biological and/or chemical samples.

BACKGROUND

DNA polymerases are nucleotide polymerizing enzymes that are essential for the replication of the genomes of all living organisms. In addition to their role in maintaining genome integrity during replication and repair, DNA polymerases are widely used for DNA manipulation in vitro, including DNA cloning, mutagenesis, and sequencing. The fundamental ability of DNA polymerases to synthesize a complementary strand according to a template DNA is conserved, although specific properties, including processivity, fidelity, and substrate nucleotide selectivity, differ among the enzymes.

SUMMARY

Aspects of the technology disclosed herein relate to modified polymerizing enzymes (e.g., polymerases) that may be used to conduct in vitro polymerization reactions. In some aspects, polymerases described herein are suitable for use in sequencing reactions (e.g., nucleic acid sequencing). In some aspects, the disclosure provides recombinant polymerases having one or more modifications. In some embodiments, recombinant polymerases of the disclosure comprise at least one of an amino acid mutation or a domain substitution.

In some aspects, the disclosure provides a modified polymerizing enzyme (e.g., a nucleic acid polymerizing enzyme, or a nucleic acid polymerase) having an amino acid sequence that is based on a naturally occurring polymerase (e.g., selected from Table 1) and that includes one or more amino acid mutations and/or segment substitutions. In some embodiments, a modified polymerizing enzyme comprises one or more segment substitutions (e.g., wherein one or more segments of a polymerase are replaced with one or more corresponding segments from a different polymerase), one or more amino acid additions, deletions, and/or substitutions, or a combination thereof. In some embodiments, a segment comprises a defined region of a polymerase (e.g., a structural or functional domain or subdomain), or a portion thereof, and optionally including one or more flanking amino acids (e.g., 1-50, 1-40, 1-30, 1-20, 5-10, 5-25, or any integral number within these ranges of amino acids on either side of a region or portion thereof, for example in a naturally-occurring polymerase of Table 1). In some embodiments, one or more amino acid insertions, deletions, or substitutions correspond to naturally occurring differences between two naturally-occurring polymerases at one or more positions. In some embodiments, one or more amino acid insertions, deletions, or substitutions are new non-naturally occurring changes. In some embodiments, an amino acid substitution is a conservative amino acid substitution (e.g., replacing one amino acid with another amino acid having similar properties, for example having similar charged, polar, hydrophobic, hydrophilic, and/or other similar properties such as similar size). In some embodiments, an amino acid substitution is a non-conservative amino acid substitution. In some embodiments, one or more amino acid insertions, deletions, or substitutions can be at any position(s) in a modified polymerase, including in one or more swapped segments from different polymerases and/or in segments of the original polymerase.

Accordingly, in some embodiments the disclosure provides a recombinant polymerizing enzyme having an amino acid sequence selected from Table 1 (or having an amino acid sequence that has at least 50%, at least 60%, at least 70%, at least 80%, 80-90%, 90-95%, 95-99%, or higher amino acid sequence identity to an amino acid sequence selected from Table 1) and comprising one or more amino acid modifications from Table 2, Table 3, Table 4, or Table 5. In some embodiments, the one or more amino acid modifications include at least one amino acid mutation (e.g., 1, 2, 3, 4, 5, 6, 7, 8, 9, 10, 15, 20, 25, or more amino acid mutations). In some embodiments, the one or more amino acid modifications include at least 1 and up to 5 amino acid mutations, at least 1 and up to 10 amino acid mutations, at least 1 and up to 15 amino acid mutations, at least 1 and up to 25 amino acid mutations, at least 1 and up to 50 amino acid mutations, or at least 1 and up to 100 amino acid mutations. In some embodiments, the one or more amino acid modifications include at least one domain substitution (e.g., a substitution of an entire domain or a substitution of a segment that encompasses a domain or a portion of a domain). In some embodiments, the at least one domain substitution comprises at least one of an exonuclease domain substitution and a polymerase domain substitution. In some embodiments, an exonuclease domain substitution comprises an exonuclease loop substitution. In some embodiments, a polymerase domain substitution comprises any one of a palm subdomain substitution, a TPR1 subdomain substitution, a fingers subdomain substitution, a TPR2 subdomain substitution, or a thumb subdomain substitution (e.g., a substitution of an entire polymerase, palm, TPR1, fingers, TPR2, or thumb domain or subdomain, or a portion of any one thereof, optionally including one or more flanking amino acids). In some embodiments, the one or more amino acid modifications include at least one domain substitution and at least one amino acid mutation. In some embodiments, an amino acid mutation can be an amino acid insertion, deletion, or substitution.

In some embodiments, a recombinant polymerizing enzyme of the disclosure has a sequence selected from Table 2. In some embodiments, the disclosure provides a recombinant polymerizing enzyme having a sequence selected from Table 3.

In some embodiments, a recombinant polymerizing enzyme further comprises a purification tag. In some embodiments, the purification tag is covalently bound to a region within the polymerizing enzyme sequence. In some embodiments, the purification tag is covalently bound at a terminal end of the polymerizing enzyme sequence. In some embodiments, the purification tag is a C-terminal tag. In some embodiments, the purification tag is an N-terminal tag. In some embodiments, the purification tag is a His tag (e.g., a sequence of repeating histidine residues, such as a hexa-histidine sequence).

In some embodiments, a recombinant polymerizing enzyme further comprises a coupling group. In some embodiments, the coupling group is attached at a region within the polymerizing enzyme sequence. In some embodiments, the coupling group is attached at a terminal end of the polymerizing enzyme. In some embodiments, the coupling group is attached at a C-terminal end of the recombinant polymerizing enzyme. In some embodiments, the coupling group is attached at an N-terminal end of the recombinant polymerizing enzyme. In some embodiments, the coupling group is a biotinylation sequence. In some embodiments, a recombinant polymerizing enzyme comprises (e.g., at its C terminus) a purification tag (e.g., a His tag) and a coupling group (e.g., a biotinylation sequence) directly connected or separated by a peptide linker (e.g., 5-15 amino acids long or longer).

In some embodiments, a recombinant polymerizing enzyme is immobilized on a surface. In some embodiments, the surface comprises a coupling group configured to bind the recombinant polymerizing enzyme. In some embodiments, the surface comprises a nanoaperture. In some embodiments, the surface comprises a bottom surface of a sample well. In some embodiments, the sample well is disposed among a plurality of sample wells on a surface (e.g., a surface of a chip or an integrated device). In some embodiments, each of the plurality of sample wells are configured to receive a recombinant polymerizing enzyme. In some embodiments, each of the plurality of sample wells comprising a recombinant polymerizing enzyme are capable of conducting a single molecule sequencing reaction.

In some aspects, the disclosure provides an isolated nucleic acid molecule that encodes a recombinant polymerizing enzyme described herein. In some embodiments, the isolated nucleic acid molecule comprises RNA. In some embodiments, the isolated nucleic acid molecule comprises DNA. In some embodiments, the isolated nucleic acid molecule comprises a viral vector. In some embodiments, the isolated nucleic acid molecule comprises an expression vector. In some embodiments, the isolated nucleic acid molecule comprises a plasmid. In some embodiments, the isolated nucleic acid includes a promoter (e.g., an inducible promoter). In some embodiments, the isolated nucleic acid is in a host cell capable of expressing the recombinant polymerizing enzyme. In some embodiments, the recombinant polymerizing enzyme is isolated from the host cell (e.g., from a host cell preparation, for example after growth in a bioreactor and induction of an inducible promoter).

In some aspects, the disclosure provides a composition comprising a recombinant polymerizing enzyme described in this application. In some embodiments, the composition is used in a method of sequencing a nucleic acid. In some embodiments, the composition further comprises a sequencing reaction mixture. In some embodiments, the sequencing reaction mixture can include one or more of a nucleoside polyphosphate (e.g., a nucleoside comprising more than one phosphate group, such as a nucleotide or a nucleoside hexaphosphate), a template nucleic acid to be sequenced, a nucleic acid primer that serves as a starting point for complementary strand synthesis, a divalent metal ion, a buffer component, and a salt. In some embodiments, the nucleoside polyphosphate comprises a detectable moiety (e.g., a luminescent label).

In some aspects, the disclosure provides a method of sequencing a nucleic acid by contacting a recombinant polymerizing enzyme described in this application with a sequencing reaction mixture. In some embodiments, the sequencing reaction mixture can include one or more of a nucleoside polyphosphate (e.g., a nucleoside comprising more than one phosphate group, such as a nucleotide or a nucleoside hexaphosphate), a template nucleic acid to be sequenced, a nucleic acid primer that serves as a starting point for complementary strand synthesis, a divalent metal ion, a buffer component, and a salt. In some embodiments, the nucleoside polyphosphate comprises a luminescent label. In some embodiments, the method further comprises detecting incorporation of one or more nucleoside polyphosphates in a growing strand complementary to the template nucleic acid. In some embodiments, detecting comprises measuring one or more luminescent properties (e.g., lifetime, intensity, photon arrival time, quantum yield) of a luminescently labeled nucleoside polyphosphate involved in an incorporation event.

In some aspects, the disclosure provides a recombinant polymerizing enzyme comprising a segment that includes an exonuclease region or a portion thereof (and optionally flanking amino acids on one or both sides) of any one of recombinant polymerizing enzymes in Table 1. In some aspects, the disclosure provides a recombinant polymerizing enzyme comprising a segment that includes a palm region or a portion thereof (and optionally flanking amino acids on one or both sides) of any one of recombinant polymerizing enzymes in Table 1. In some aspects, the disclosure provides a recombinant polymerizing enzyme comprising a segment that includes a TPR1 region or a portion thereof (and optionally flanking amino acids on one or both sides) of any one of recombinant polymerizing enzymes in Table 1. In some aspects, the disclosure provides a recombinant polymerizing enzyme comprising a segment that includes a fingers region or a portion thereof (and optionally flanking amino acids on one or both sides) of any one of recombinant polymerizing enzymes in Table 1. In some aspects, the disclosure provides a recombinant polymerizing enzyme comprising a segment that includes a TPR2 region or a portion thereof (and optionally flanking amino acids on one or both sides) of any one of recombinant polymerizing enzymes in Table 1. In some aspects, the disclosure provides a recombinant polymerizing enzyme comprising a segment that includes a thumb region or a portion thereof (and optionally flanking amino acids on one or both sides) of any one of recombinant polymerizing enzymes in Table 1. In some aspects, the disclosure provides a recombinant polymerizing enzyme comprising two or more segments as described herein.

Accordingly, in some embodiments, a recombinant polymerizing enzyme is a chimeric enzyme that comprises one or more amino acid segments from different polymerizing enzymes (e.g., from a different species). In some embodiments, a chimeric polymerase comprises an amino acid sequence from a first polymerizing enzyme in which one or more segments have been replaced with segment(s) from different polymerizing enzymes. In some embodiments, the one or more segments from different polymerizing enzymes can be a segment comprising amino acids 1-51 from the M2Y polymerase, a segment comprising amino acids 271-375 from the *E. faecium* polymerase, a segment comprising amino acids 72-89 from the *E. faecium* polymerase, and/or a segment comprising amino acids 445-449 from the *E. faecium* polymerase. In some embodiments, the 1-51 segment from M2Y polymerase replaces a corresponding naturally occurring polymerase segment (e.g., amino acids 1-54 of Φ29 polymerase). In some embodiments, the 271-375 segment from *E. faecium* polymerase replaces a corresponding naturally occurring polymerase segment (e.g., amino acids 260-359 of Φ29 polymerase). In some embodiments, the 72-89 segment from *E. faecium* polymerase replaces a corresponding naturally occurring polymerase segment (e.g., amino acids 75-91 of Φ29 polymerase). In some embodiments, the 445-449 segment from *E. faecium* polymerase replaces a corresponding naturally occurring polymerase segment (e.g., amino acids 429-433 of Φ29 polymerase).

In some embodiments, a recombinant polymerizing enzyme comprises one or more substitutions corresponding to the following substitutions in Φ2929: M8R, V51A, N62D, I71V, L107I, K131E, K135Q, L142K, G197D, Y224K, E239G, V250A/I, L253A/H, Y281H, I288L, T301C, R306Q, R308L, D325E, D341E, K354R, T368F, E375Y, A437G, A444T, E466K, D476H, A484E, E508R, D510K/R, K512Y, E515Q, K539E, D570S, and T571V.

In some embodiments, a modified polymerase comprises one or more of the segment substitutions and/or amino acid insertions, deletions, and/or substitutions described herein, and also comprises one or more (e.g., 1-5, 5-10, 10-25, 25-50, 50-75, 75-100, 100-125, 125-150) additional amino acid insertions, deletions, and/or substitutions (e.g., conservative or non-conservative amino acid substitutions). Accordingly, in some embodiments, a modified polymerase of Table 2 or Table 3 can include one or more additional (e.g., 1-5, 5-10, 10-25, 25-50, 50-75, 75-100, 100-125, 125-150) additional amino acid insertions, deletions, and/or substitutions (e.g., conservative or non-conservative amino acid substitutions).

These and other aspects are described in more detail in the following detailed description and illustrated by the non-limiting drawings and examples.

BRIEF DESCRIPTION OF THE DRAWINGS

The skilled artisan will understand that the figures, described herein, are for illustration purposes only. It is to be understood that, in some instances, various aspects of the invention may be shown exaggerated or enlarged to facilitate an understanding of the invention. In the drawings, like reference characters generally refer to like features, functionally similar and/or structurally similar elements throughout the various figures. The drawings are not necessarily to scale, emphasis instead being placed upon illustrating the principles of the teachings. The drawings are not intended to limit the scope of the present teachings in any way.

The features and advantages of the present invention will become more apparent from the detailed description set forth below when taken in conjunction with the drawings.

When describing embodiments in reference to the drawings, direction references ("above," "below," "top," "bottom," "left," "right," "horizontal," "vertical," etc.) may be used. Such references are intended merely as an aid to the reader viewing the drawings in a normal orientation. These directional references are not intended to describe a preferred or only orientation of an embodied device. A device may be embodied in other orientations.

As is apparent from the detailed description, the examples depicted in the figures (e.g., FIGS. 1-7) and further described for the purpose of illustration throughout the application describe non-limiting embodiments, and in some cases may simplify certain processes or omit features or steps for the purpose of clearer illustration.

Figure 1:
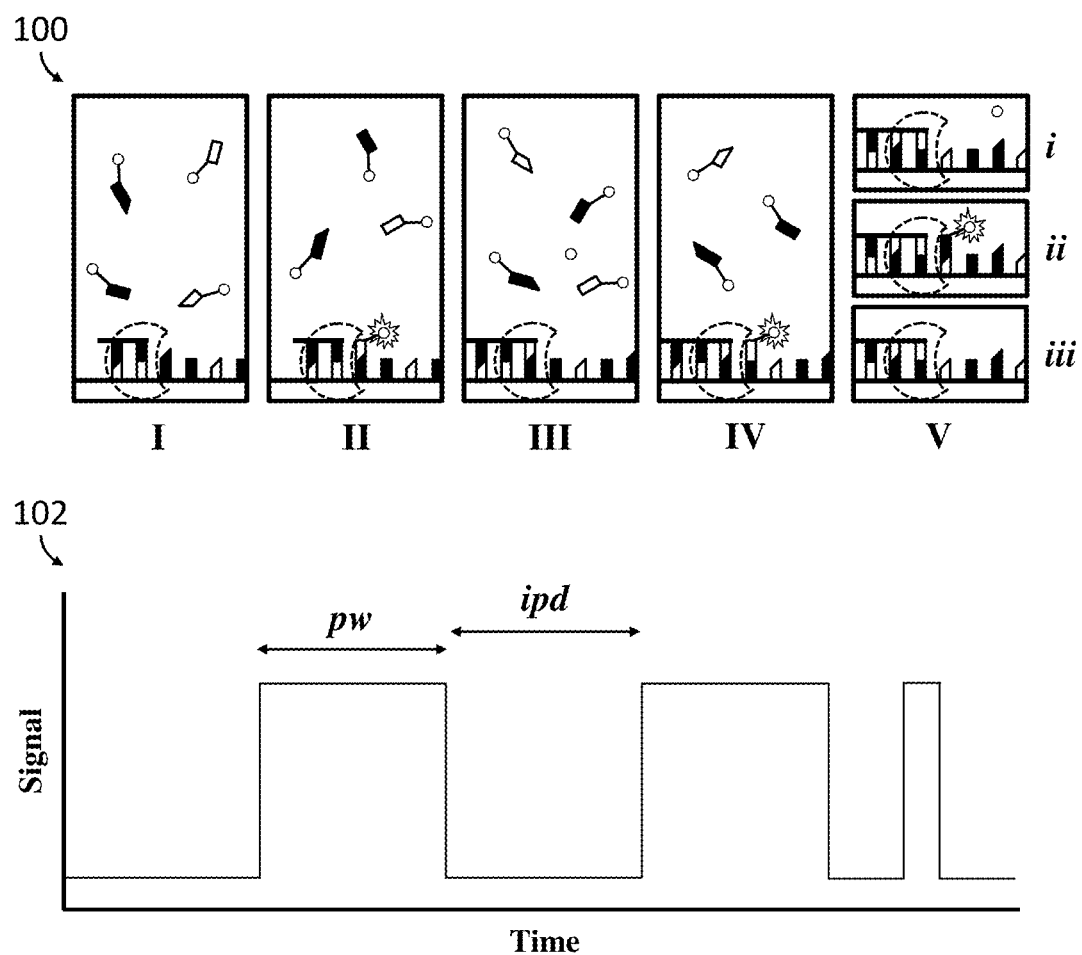

FIG. 1 is a schematic that illustrates the progression of a polymerization reaction in relation to signal readout in a non-limiting process for monitoring single molecule processes.

Figure 2:
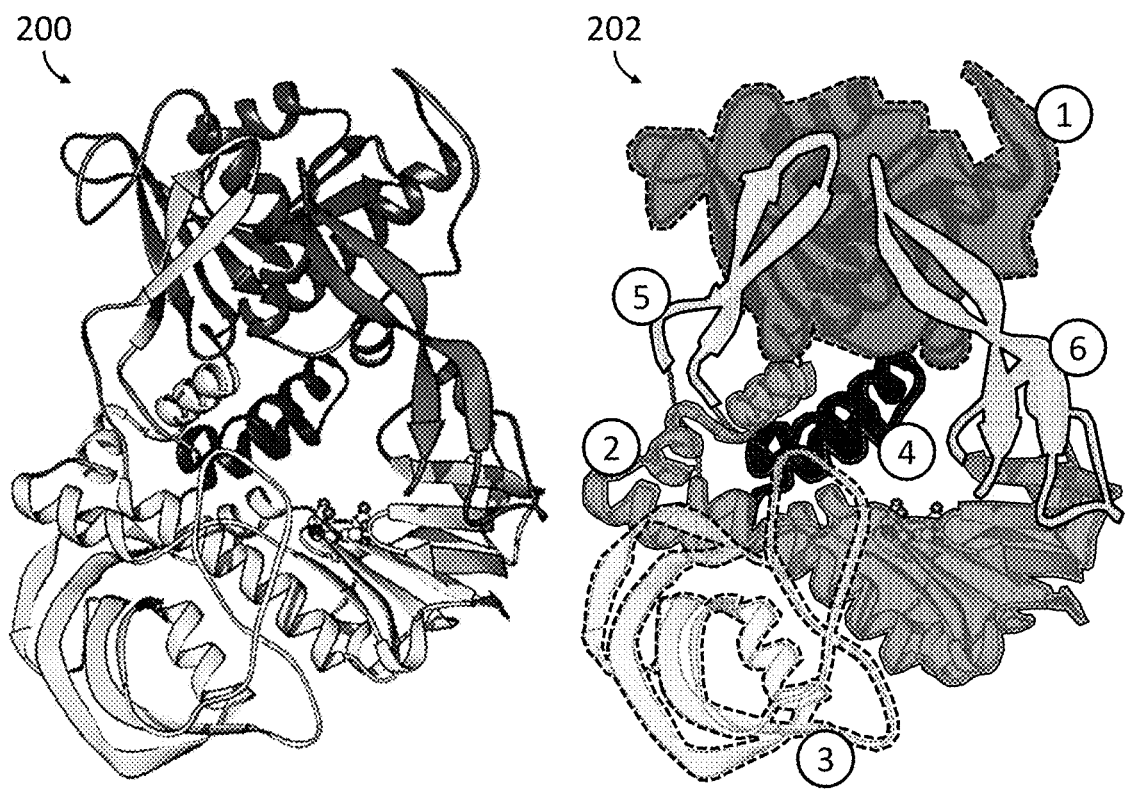
Figure 2:
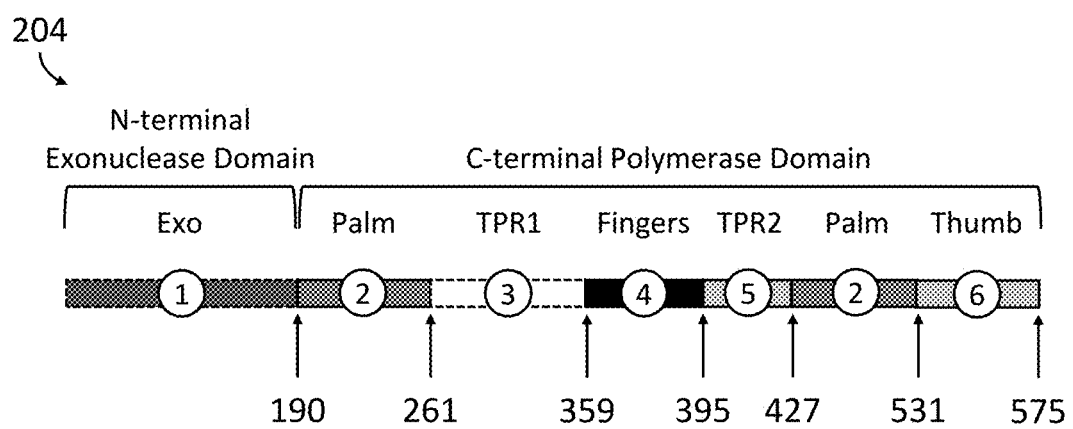

FIG. 2 is a non-limiting illustration that depicts the structure of Φ29 polymerase and domains and subdomains of the polymerase.

Figure 3:
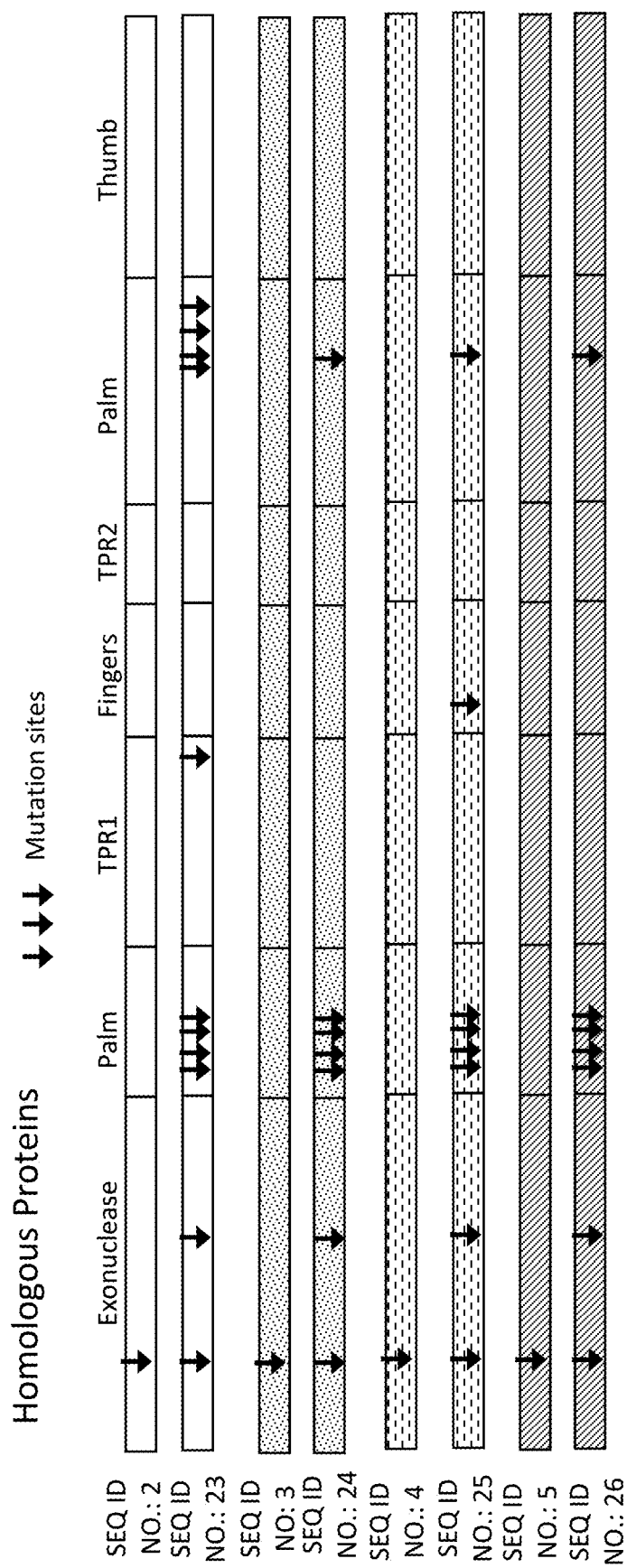

FIG. 3 depicts non-limiting examples of selected mutational variants with sites of mutation within domains and subdomains of polypeptide strands.

Figure 4:
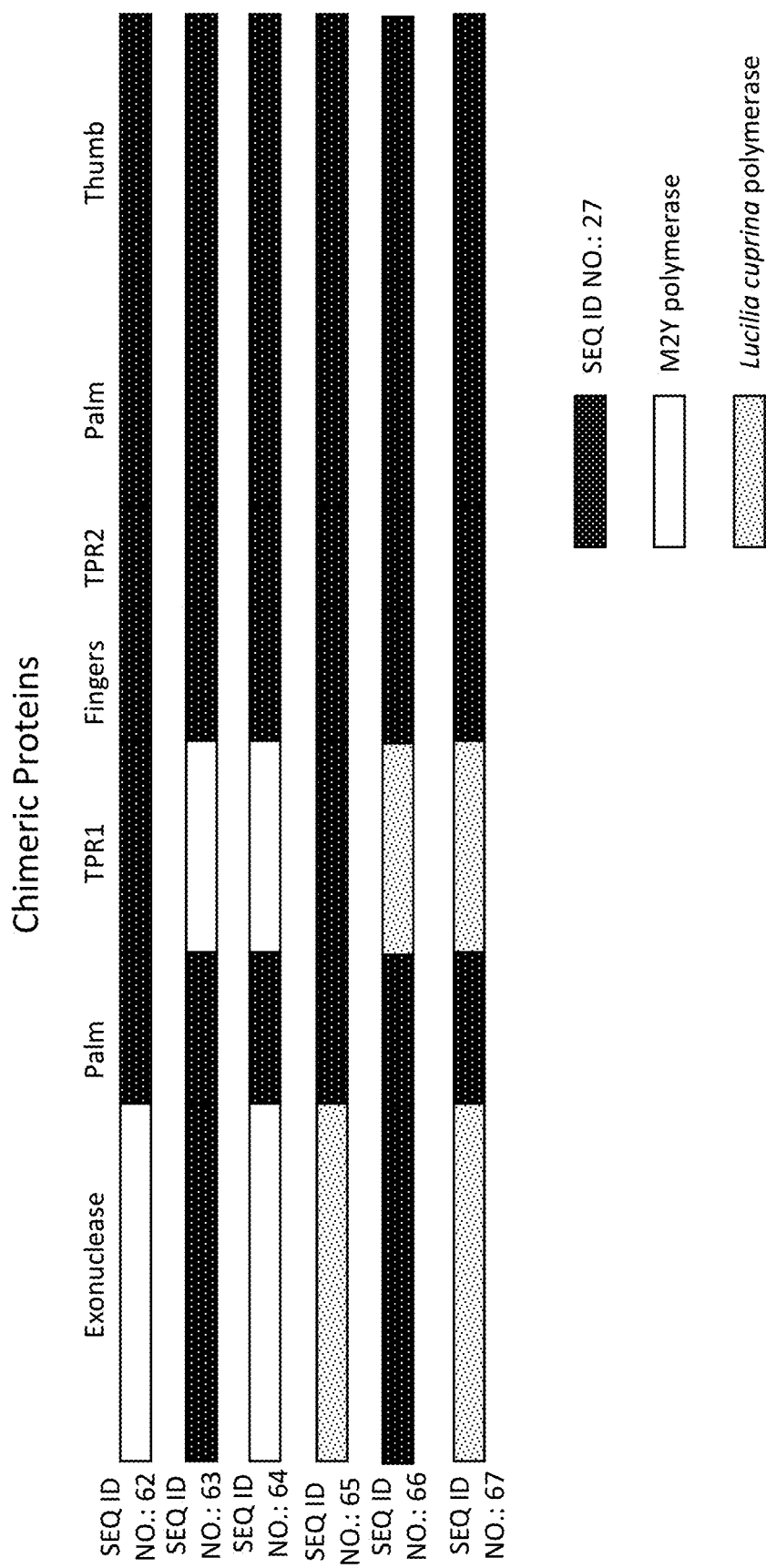

FIG. 4 depicts non-limiting examples of selected chimeric polymerase variants having different domains and subdomains substituted into the polypeptide strands.

Figure 5A:
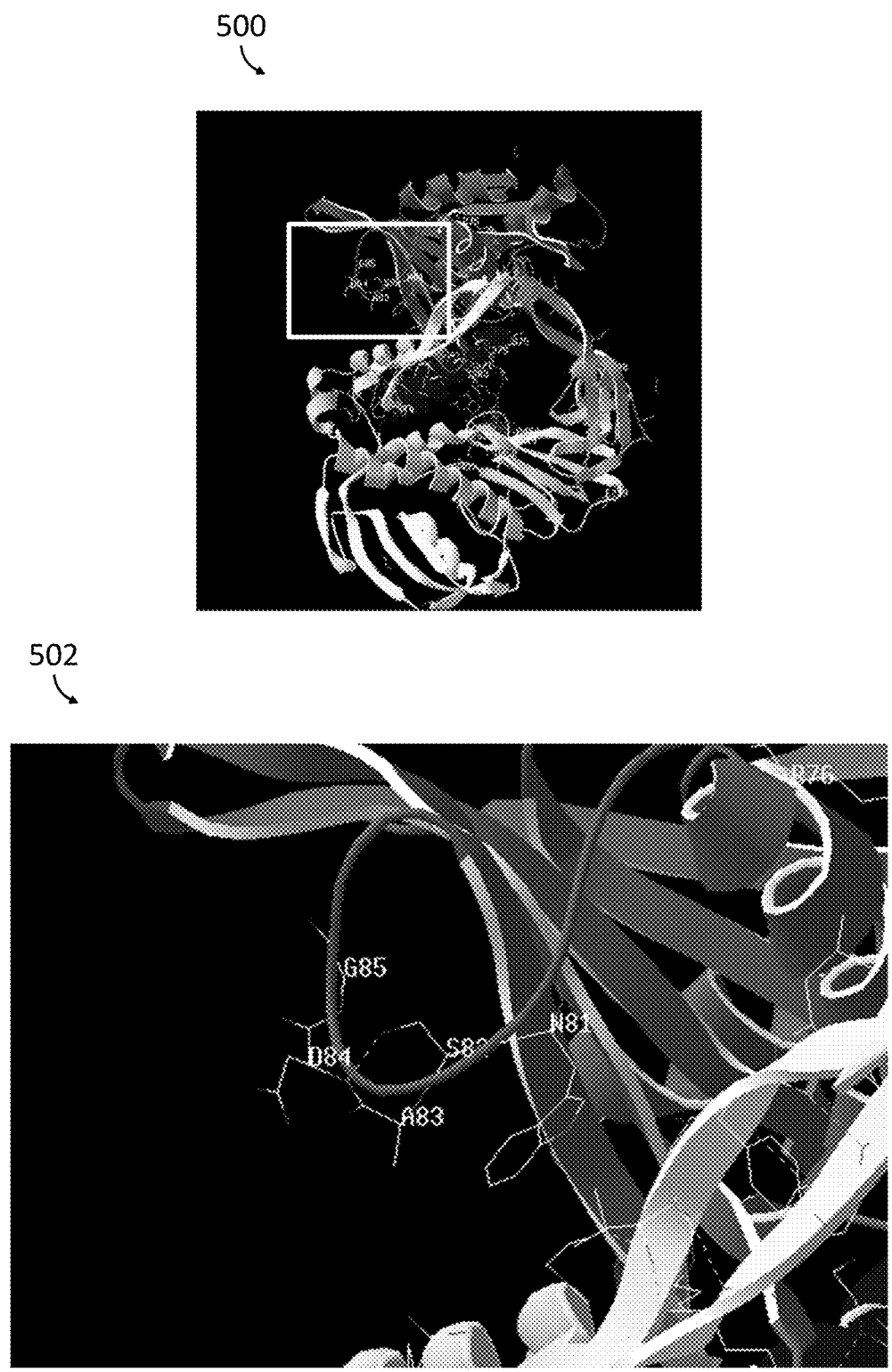

FIG. 5A is a non-limiting illustration that depicts a loop region in an exonuclease domain of Φ29 polymerase.

Figure 5B:
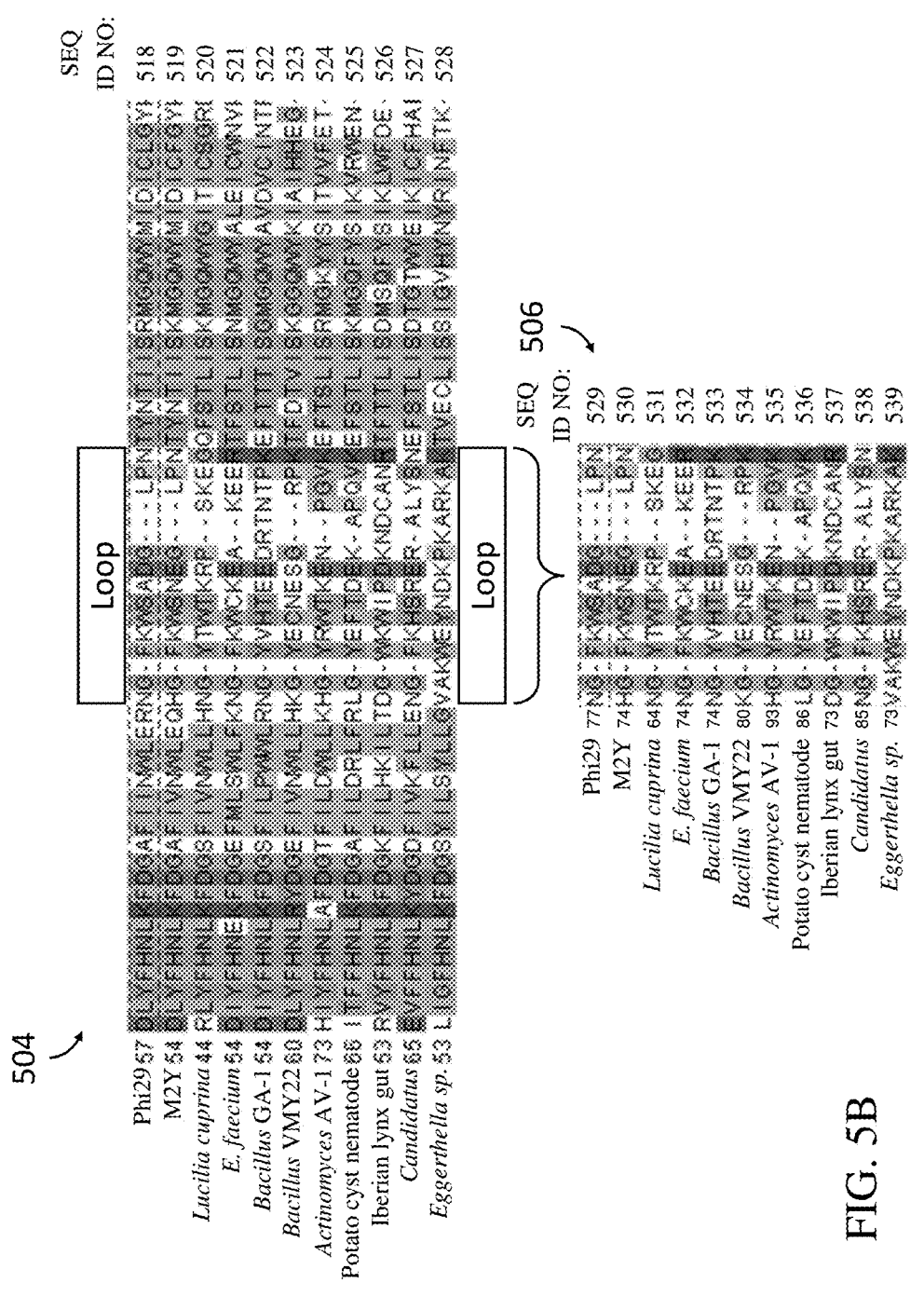

FIG. 5B depicts a sequence homology alignment between exonuclease regions of Φ29 polymerase and a non-limiting set of other polymerases.

Figure 6:
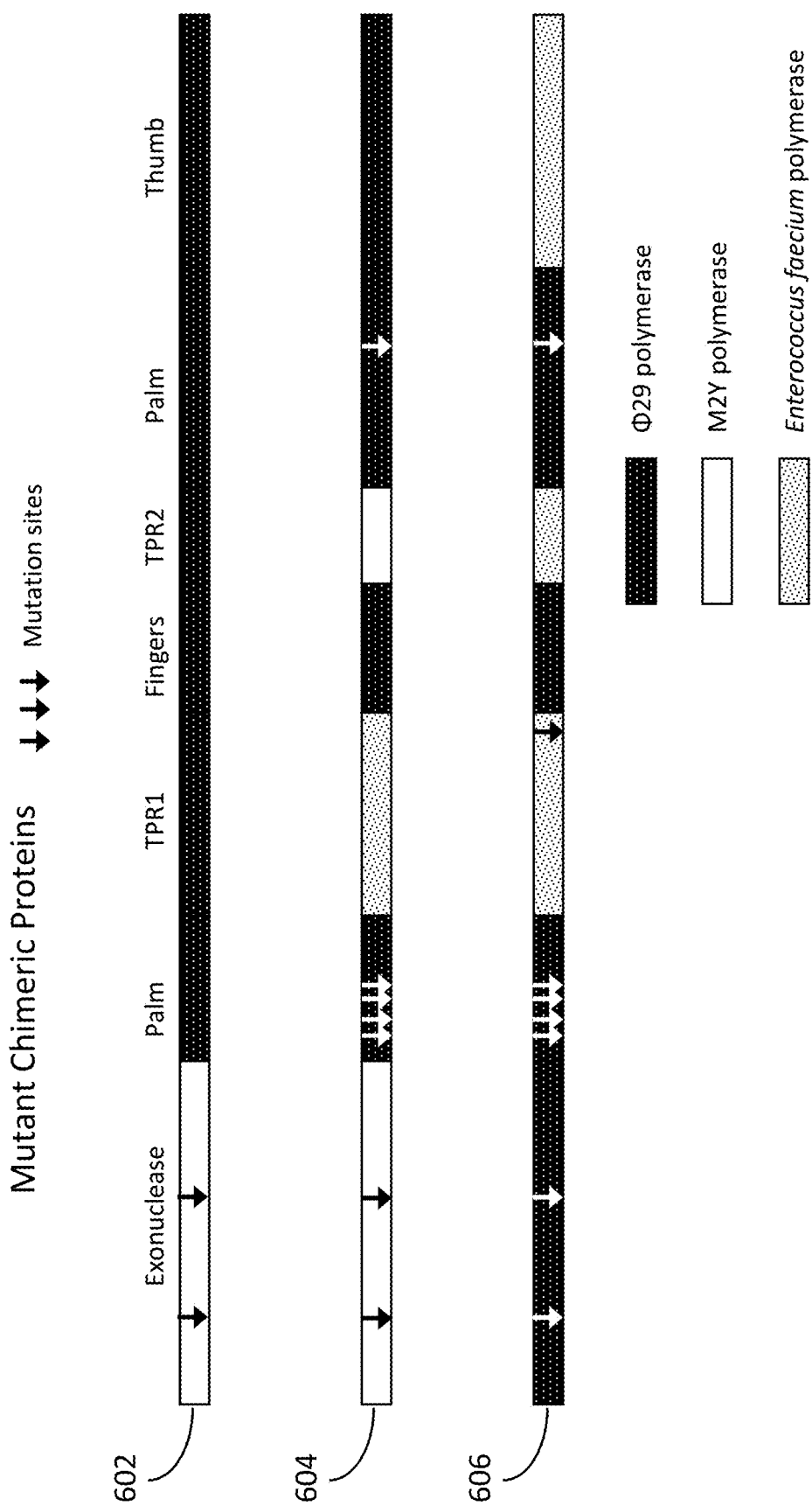

FIG. 6 depicts non-limiting generic examples of chimeric polymerase variants comprising one or more site-specific mutations.

Figure 7:
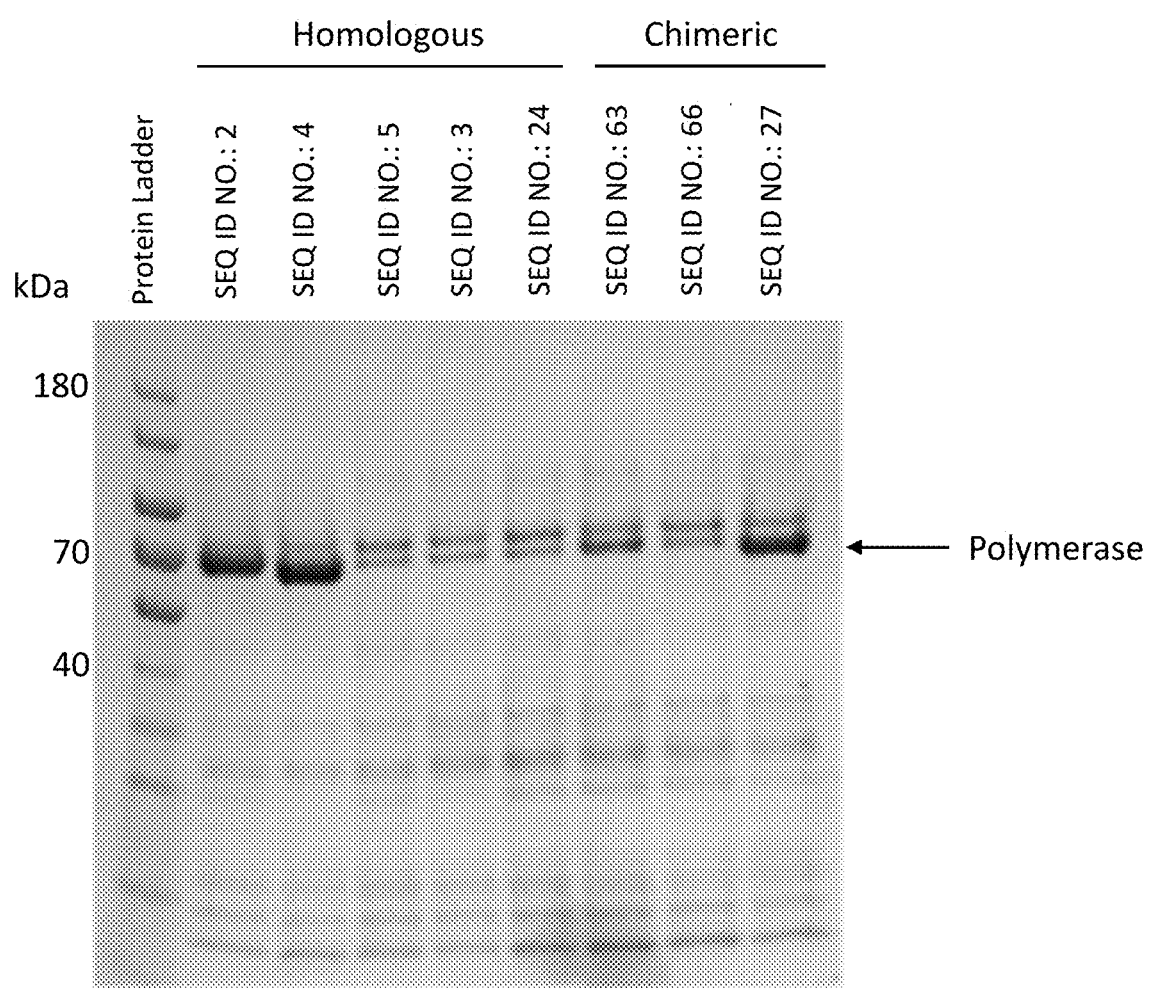

FIG. 7 is a picture of an SDS-PAGE conducted to evaluate purity of polymerases expressed in *E. coli*.

DETAILED DESCRIPTION

Aspects of the disclosure relate to modified polymerizing enzymes and compositions thereof. In some aspects, the disclosure provides methods of using modified recombinant polymerizing enzymes and compositions comprising the enzymes. In some embodiments, the disclosure provides modified recombinant polymerizing enzymes and compositions which may be used for conducting in vitro polymerization reactions. In some aspects, the polymerizing enzymes described herein are modified recombinant nucleic acid polymerases, e.g., modified recombinant DNA polymerases. In some embodiments, modified recombinant DNA polymerases provided by the disclosure may be used for in vitro reactions related to the manipulation of DNA (e.g., DNA sequencing).

Among other aspects, the disclosure provides modified polymerizing enzymes (e.g., polymerases) that may be used to conduct in vitro polymerization reactions. In some embodiments, polymerases described herein comprise one or more modifications which—individually or in combination—are useful to conduct a sequencing reaction. In some embodiments, one or more of the modifications described herein can be utilized to produce a polymerase having one or more properties useful for conducting sequencing reactions, e.g., properties such as polymerase processivity, fidelity (e.g., accuracy), substrate (e.g., nucleoside polyphosphate) binding affinity, substrate utilization (e.g., the rate at which nucleoside polyphosphates are incorporated into a growing strand complementary to a template strand), polymerase interactions with modified substrates (e.g., labeled nucleoside polyphosphates), or some combination thereof. In some embodiments, one or more of the modifications minimize or eliminate proofreading capability of the polymerase. For example, in some embodiments, one or more modifications may be made to an exonuclease domain of a polymerase that effects a loss in exonuclease activity of the polymerase.

In some aspects, the application relates to modified polymerases having altered biochemical properties that are advantageous for single molecule nucleic acid sequencing technologies. In some embodiments, variant polymerases described herein have been modified to provide improved signal readout in single molecule sequencing reactions. FIG. 1 provides an example illustration of the progression of a sequencing reaction in relation to the real-time signal readout. Without wishing to be bound by theory, it is thought that some single molecule nucleic acid sequencing reactions proceed in accordance with scheme 100.

At the start of a reaction (panel I), a polymerase (dashed line) is confined in an observation region and is bound to a template strand and a primer strand. As shown, different types of nucleotides (e.g., A, G, T, C, U), each having different types of detectable labels, are present in the same reaction mixture. When the polymerase associates with a luminescently labeled nucleotide (panel II), the label becomes confined in the observation region for a period of time. During an incorporation event, for example, this period of time can be sufficient for the label to receive and/or emit energy in an amount sufficient to detect and identify its presence in the observation region. As illustrated by panels I and II of scheme 100 in relation to signal readout 102, an incorporation event can be associated with a signal pulse for a period of time corresponding to pulse width, pw.

It should be appreciated that, in some embodiments, an individual signal pulse associated with an incorporation event can be affected by a variety of conditions, such as the type of nucleotide being incorporated or the activity of the polymerase at a specific point in time. In some embodiments, an individual signal pulse can have an individual pulse width of between about 10 milliseconds and about 10 seconds. Accordingly, in some embodiments, individual pulse widths may be averaged to provide a parameter for comparative purposes. As used herein, in some embodiments, "pulse width" refers to a value corresponding to an average of a plurality of individual signal pulses, each individual signal pulse having an individual pulse width.

In some embodiments, modified polymerizing enzymes of the present application produce pulse widths of between about 10 milliseconds and about 10 seconds. In some embodiments, pulse width is at least 10 milliseconds and up to 10 seconds, at least 10 milliseconds and up to 5 seconds, at least 10 milliseconds and up to 1 second, or between about 10 milliseconds and about 1 second. In some embodiments, pulse width is between about 10 and about 500 milliseconds, between about 10 and about 200 milliseconds, between about 10 and about 100 milliseconds, between about 10 and about 50 milliseconds, between about 50 milliseconds and about 1 second, between about 50 and about 500 milliseconds, between about 50 and about 200 milliseconds, between about 50 and about 100 milliseconds, between about 100 milliseconds and about 1 second, between about 100 and about 500 milliseconds, between about 100 and about 200 milliseconds, between about 200 milliseconds and about 1 second, between about 200 and about 500 milliseconds, or between about 500 milliseconds and about 1 second.

Following incorporation of the nucleotide into the growing strand and cleavage of the luminescent label, the label diffuses out of the illumination volume and is no longer detectable in the observation region (panel III). Also as illustrated in panel III, following an incorporation event, the polymerase progresses along the template strand such that it is capable of associating with a subsequent luminescently labeled nucleotide. Similar to the progression from panel I to panel II, the signal corresponding to the progression from panel III to panel IV in signal trace 102 increases in intensity from a relatively low intensity level to a signal pulse indicative of an association event. In terms of signal trace 102, the period of time between an incorporation event and a subsequent association event can be associated with an interpulse distance, ipd.

As detailed in the foregoing with respect to pulse width, in some embodiments, an individual interpulse distance associated with a period of time between a first and second signal pulse can be affected by a variety of conditions, such as the activity or processivity of the polymerase at a specific point in time. In some embodiments, an individual interpulse distance corresponds to a period of between about 10 milliseconds and about 1 minute or longer (e.g., between about 1 and about 60 seconds, between about 1 and about 30 seconds, between about 1 and about 20 seconds, between about 1 and about 10 seconds, or less than about 1 second). Accordingly, in some embodiments, individual interpulse distances may be averaged to provide a parameter for comparative purposes. As used herein, in some embodiments, "interpulse distance" refers to a value corresponding to an average of a plurality of individual interpulse distances.

In some embodiments, modified polymerizing enzymes of the present application produce interpulse distances of between about 10 milliseconds and about 10 seconds. In some embodiments, interpulse distance is at least 10 milliseconds and up to 10 seconds, at least 10 milliseconds and up to 5 seconds, at least 10 milliseconds and up to 1 second, or between about 10 milliseconds and about 1 second. In some embodiments, interpulse distance is between about 10 and about 500 milliseconds, between about 10 and about 200 milliseconds, between about 10 and about 100 milliseconds, between about 10 and about 50 milliseconds, between about 50 milliseconds and about 1 second, between about 50 and about 500 milliseconds, between about 50 and about 200 milliseconds, between about 50 and about 100 milliseconds, between about 100 milliseconds and about 1 second, between about 100 and about 500 milliseconds, between about 100 and about 200 milliseconds, between about 200 milliseconds and about 1 second, between about 200 and about 500 milliseconds, or between about 500 milliseconds and about 1 second.

Characteristics of a pulse width and/or an interpulse distance, in some embodiments, can be used to identify a specific luminescent label. In some embodiments, modified polymerases of the disclosure can be used in a sequencing reaction by observing a series of pulse widths indicative of the association of luminescently labeled nucleotides to determine a nucleotide sequence of a template strand. In some embodiments, artefacts in this process can give rise to incorrect sequencing information. For example, panel V illustrates a bind-and-release event in which a luminescently labeled nucleotide is confined in the observation region for a period of time sufficient to give rise to a signal pulse, but without an incorporation event.

As shown in panel V, following the detected incorporation in panel IV, the cleaved luminescent label diffuses out of the observable region (i). A further luminescently labeled nucleotide associates with the polymerase in the observable region to give rise to a detectable signal (ii). Rather than being incorporated into the growing strand, the luminescently labeled nucleotide dissociates from the polymerase and diffuses back into the reaction mixture (iii). As such, following a subsequently successful incorporation of the same type of nucleotide (not shown), the signal pulse corresponding to panel V would result in an apparent insertion in sequencing information readout. Accordingly, in some embodiments, modified polymerases of the present application have pulse widths of sufficient length to discern true incorporation events from these and other such artefact events. In some embodiments, modified polymerases of the present application have one or more modifications that decrease the probability of premature substrate release from a polymerase active site. In some embodiments, modified polymerases of the present application have one or more modifications that increase the probability of substrate incorporation once a substrate is associated with a polymerase active site.

In some embodiments, modified polymerases provided by the disclosure comprise a polymerase sequence according to the wild-type polymerase sequences set forth in Table 1 (SEQ ID NOs: 1-19) with one or more modifications (e.g., as exemplified in Tables 2-5, or combinations of two or more thereof).

TABLE 1

Wild-Type Polymerase Amino Acid Sequence

| Name | SEQ ID NO. | Sequence |
|---|---|---|
| Φ29 | 1 | MKHMPRKMYSCDFETTTKVEDCRVWAYGYMNIEDHSEYKIGNSLDEFMAWVLK VQADLYFHNLKFDGAFIINWLERNGFKWSADGLPNTYNTIISRMGQWYMIDIC LGYKGKRKIHTVIYDSLKKLPFPVKKIAKDFKLTVLKGDIDYHKERPVGYKIT PEEYAYIKNDIQIIAEALLIQFKQGLDRMTAGSDSLKGFKDIITTKKFKKVFP TLSLGLDKEVRYAYRGGFTWLNDRFKEKEIGEGMVFDVNSLYPAQMYSRLLPY GEPIVFEGKYVWDEDYPLHIQHIRCEFELKEGYIPTIQIKRSRFYKGNEYLKS SGGEIADLWLSNVDLELMKEHYDLYNVEYISGLKFKATTGLFKDFIDKWTYIK TTSEGAIKQLAKLMLNSLYGKFASNPDVTGKVPYLKENGALGFRLGEEETKDP VYTPMGVFITAWARYTTITAAQACYDRIIYCDTDSIHLTGTEIPDVIKDIVDP KKLGYWAHESTFKRAKYLRQKTYIQDIYMKEVDGKLVEGSPDDYTDIKFSVKC AGMTDKIKKEVTFENFKVGFSRKMKPKPVQVPGGVVLVDDTFTIK |
| M2Y | 2 | MSRKMFSCDFETTTKLDDCRVWAYGYMEIGNLDNYKIGNSLDEFMQWVMEIQA DLYFHDLKFDGAFIVNWLEQHGFKWSNEGLPNTYNTIISKMGQWYMIDICFGY KGKRKLHTVIYDSLKKLPFPVKKIAKDFQLPLLKGDIDYHTERPVGHEITPEE YEYIKNDIEIIARALDIQFKQGLDRMTAGSDSLKGFKDILSTKKFNKVFPKLS LPMDKEIRKAYRGGFTWLNDKYKEKEIGEGMVFDVNSLYPSQMYSRPLPYGAP IVFQGKYEKDEQYPLYIQRIRFEFELKEGYIPTIQIKKNPFFKGNEYLKNSGV EPVELYLTNVDLELIQEHYELYNVEYIDGFKFREKTGLFKDFIDKWTYVKTHE EGAKKQLAKLMLNSLYGKFASNPDVTGKVPYLKDDGSLGFRVGDEEYKDPVYT PMGVFITAWARFTTITAAQACYDRIIYCDTDSIHLTGTEVPEIIKDIVDPKKL GYWAHESTFKRAKYLRQKTYIQDIYVKEVDGKLKECSPDEATTTKFSVKCAGM TDTIKKKVTFDNFAVGFSSMGKPKPVQVNGGVVLVDSVFTIK |
| Lucilia cuprina WT | 3 | MARKRPIRITKNDRAEYKRLSKNAKSKLNRTVKNYGIDLSNDVDIPKLSDFKT RKEFNDWKQKITSFTSRSNQEYQFRKNEYGVVASVKELNEIKRNTKKAQKIAK EKIDKAMKLDFYVEGERQGKVKDRIKLMKKEEVAGVSVPVDFDFDKIQTRKRL EDKAGFMEERATGDYYRKKDIQMKENFISMIEQGFNSDADEVIKKLKKIPPDD FVELTIVTDEIDFRNYGSKNEGGINDEDKLEELNNTLNDYFNETTTDVNDCRV WAYGWMEIGKTSNYKIGTDFNEFMEWMIHSSSRLYFHNLKFDGSFIVNWLLHN GYTWTKRPSKEGQFSTLISKMGQWYGITICSGRDGRKKKLTTIHDSLKKLPFP VRKIGKDFKLNVLKGDIDYHKPRPIGYEIDDEEYQYIKNDIQIIAEALEVQTV QGLTGMTNGKDALDEFVNMSGKLYEKLFPVFSLELNEEIRKAYRGGFTWLNPV YGTKKYVKDGIVFDVNSLYPSQMYDRDLPCGVPIPFEGEYVYDKSHPLYIQKL TFEFELKENYIPTIQLKNSRFGFKGNEYLSSSNGERITISVSSVDWELIREHY HVYDVEFEKGWKFRSTKQAFRQYIDKWMLVKNMSAGAKKAIAKLMLNSLYGKF ATNPDITGKRPYLREDGSNGFELMEEEFRDPVYTPVGIFITSWARYTTITSAQ KCYDRIIYCDTDSMHLEGLDVPESIKDIVADDVLGYWKKEGQFKQGKFIRQKT YMEEYYAKYVRDENGEIKYDDEKPIKTICDKEESDTTIIEIKCAGMPDNIKKH VTFDNFDIGFTMEGKLKPKQVYGGVVLVEETYTMK |
| Lucilia cuprina mod. | 4 | MKHMPRKMYSCDFETTTDVNDCRVWAYGWMEIGKTSNYKIGTDFNEFMEWMIH SSSRLYFHDLKFDGSFIVNWLLHNGYTWTKRPSKEGQFSTLISKMGQWYGITI CSGRDGRKKKLTTIHDSLKKLPFPVRKIGKDFKLNVLKGDIDYHKPRPIGYEI DDEEYQYIKNDIQIIAEALEVQTVQGLTGMTNGKDALDEFVNMSGKLYEKLFP VFSLELNEEIRKAYRGGFTWLNPVYGTKKYVKDGIVFDVNSLYPSQMYDRDLP CGVPIPFEGEYVYDKSHPLYIQKLTFEFELKENYIPTIQLKNSRFGFKGNEYL SSSNGERITISVSSVDWELIREHYHVYDVEFEKGWKFRSTKQAFRQYIDKWML VKNMSAGAKKAIAKLMLNSLYGKFATNPDITGKRPYLREDGSNGFELMEEEFR DPVYTPVGIFITSWARYTTITSAQKCYDRIIYCDTDSMHLEGLDVPESIKDIV ADDVLGYWKKEGQFKQGKFIRQKTYMEEYYAKYVRDENGEIKYDDEKPIKTIC DKEESDTTIIEIKCAGMPDNIKKHVTFDNFDIGFTMEGKLKPKQVYGGVVLVE ETYTMK |
| Enterococcus faecium | 5 | MIKKYTGDFETTTDLNDCRVWSWGVCDIDNVDNITFGLEIDSFFEWCEMQGST DIYFHDEKFDGEFMLSWLFKNGFKWCKEAKEERTFSTLISNMGQWYALEICWN VKCTTTKTGTKKEKQRTIIYDSLKKYPFPVKEIAEAFNFPIKKGEIDYTKER PIGYNPTDDEWDYLKNDIQIMAMALKIQFDQGLTRMTRGSDALGDYQDWVKTT YGKSRFKQWFPVLSLGFDKDLRKAYKGGFTWVNKVFQGKEIGEGIVFDVNSLY PSQMYVRPLPYGTPLFYEGEYKENIDYPLYIQNIKVRFRLKERHIPTIQVKQS SLFIQNEYLESSVNKLGVDELIDLTLTNVDLDLFFEHYDILEIHYTYGYMFKA SCDMFKGWIDKWIEVKNTTEGARKANAKGMLNSLYGKFGTNPDITGKVPYMGE DGIVRLTLGEEELRDPVYVPLASFVTAWGRYTTITTAQRCFDNIIYCDTDSIH LTGTEVPEAIEHLVDSKKLGYWKHESTFQRAKFIRQKTYVEEIDGELNVKCAG MPDRIKELVTFDNFEVGFSSYGKLLPKRTQGGVVLVDTMFTIK |

TABLE 1-continued

Wild-Type Polymerase Amino Acid Sequence

| Name | SEQ ID NO. | Sequence |
|---|---|---|
| Bacillus phage VMY22 | 6 | MATKKRKAYSCDFEATTSTYSETETRVWAYGWMEIGNTSHFNIGDNLDEFMLW<br>TSKECADLYFHDLRYDGEFIVNWLLHKGYECNESGRPKTFDTVISKGGQWYKI<br>AIHHEGKGTTQIFDSLKKLPFPVKTIAKAFKLPVLKGDIDYNLHRDENHVITS<br>EEFTYIKHDIEIVARALDIQINQQGLVKMTNGADSMDHFIKSLDKKKKVAERI<br>YNQYFPKMSIAMDSIFRKAYRGGFTWVNPKFKGQEVGEGMVFDVNSLYPSVMY<br>YKPLPWGKPVPFVGKYEEDPDFPLYICHIKTGFVLKEGHIPTIQIKKKNPIFQE<br>NEYLETSGGAPVDLHVTNVDLELIKEHYELYDTEYVGGWKFRQQTGIFNNFID<br>YWMKIKTDPKSTPAIVTLAKLQLNSLYGKFASHPDVTGKVPYLKDDGSTAFKK<br>GLPKSKDPVYTPAGAFITAWARHMTITTAQKVYDRILYCDTDSIHILGIDIPE<br>AIKNDIHQKELGKWAFECMFKRAKFVRQKTYVEDMYAKFMSYWEDGELNYMLK<br>ECVKEEATARLLNVKCAGMPQAVKKFVTFRTFAVGFTSDTGKLKPKHVKGGQI<br>LVDVPFTIK |
| Bacillus phage GA-1 | 7 | MARSVYVCDFETTTDPEDCRLWAWGWMDIYNTDKWSYGEDIDSFMEWALNSNS<br>DIYFHNLKFDGSFILPWWLRNGYVHTEEDRTNTPKEFTTTISGMGQWYAVDVC<br>INTRGKNKNHVVFYDSLKKLPFKVEQIAKGFGLPVLKGDIDYKKYRPVGYVMD<br>DNEIEYLKHDLLIVALALRSMFDNDFTSMTVGSDALNTYKEMLGVKQWEKYFP<br>VLSLKVNSEIRKAYKGGFTWVNPKYQGETVYGGMVFDVNSMYPAMMKNKLLPY<br>GEPVMFKGEYKKNVEYPLYIQQVRCFFELKKDKIPCIQIKGNARFGQNEYLST<br>SGDEYVDLYVTNVDWELIKKHYDIFEEEFIGGFMFKGFIGFFDEYIDRFMEIK<br>NSPDSSAEQSLQAKLMLNSLYGKFATNPDITGKVPYLDENGVLKFRKGELKER<br>DPVYTPMGCFITAYARENILSNAQKLYPRFIYADTDSIHVEGLGEVDAIKDVI<br>DPKKLGYWDHEATFQRARYVRQKTYFIETTWKENDKGKLVVCEPQDATKVKPK<br>IACAGMSDAIKERIRFNEFKIGYSTHGSLKPKNVLGGVVLMDYPFAIK |
| Actinomyces phage AV-1 | 8 | MVRQSTIASPARGGVRRSHKKVPSFCADFETTTDEDDCRVWSWGIIQVGKLQN<br>YVDGISLDGFMSHISERASHIYFHNLAFDGTFILDWLLKHGYRWTKENPGVKE<br>FTSLISRMGKYYSITVVFETGFRVEFRDSFKKLPMSVSAIAKAFNLHDQKLEI<br>DYEKPRPIGYIPTEQEKRYQRNDVAIVAQALEVQFAEKMTKLTAGSDSLATYK<br>KMTGKLFIRRFPILSPEIDTEIRKAYRGGFTYADPRYAKKLNGKGSVYDVNSL<br>YPSVMRTALLPYGEPIYSEGAPRTNRPLYIASITFTAKLKPNHIPCIQIKKNL<br>SFNPTQYLEEVKEPTTVVATNIDIELWKKHYDFKIYSWNGTFEFRGSHGFFDT<br>YVDHFMEIKKNSTGGLRQIAKLHLNSLYGKFATNPDITGKHPTLKDNRVSLVM<br>NEPETRDPVYTPMGVFITAYARKKTISAAQDNYETFAYADTDSLHLIGPTTPP<br>DSLWVDPVELGAWKHESSFTKSVYIRAKQYAEEIGGKLDVHIAGMPRNVAATL<br>TLEDMLHGGTWNGKLIPVRVPGGTVLKDTTFTLKID |
| Candidatus Moranbacteria | 9 | MKLKSKYVADFEATGEEQYKIDGSTHVWAVGVIDIETEETVLISNDIADFMNW<br>LSKDNHNHKNKEVFFHNLKYDGDFIVKFLLENGFKHSRERALYSNEFSTLISD<br>TGTWYEIKICFHALKTRKVEVKIHDSYKLLPFSEEKIAKAFKLTVSKGEIDYD<br>RYRPVGYQLQEYEVDYLKTDLLIMAQALKVQMNKGLTKMTIGSNALADYKQRI<br>SKDKFKYLFPVLDNIIDADLRHAYRGGHTYLQPFYANKILENVHSYDKNSMHP<br>SQMKNMPMPYGIPVYYEGEYKNDPDYPLFIQSIEIDCKVKKGYLPTIQPRNAF<br>RFATTEFLEDTKGEPIQLFVTSIDLMLILEHYDIHYIQYLEGFKFRSHIGLFD<br>EYIDYWYHIKETNTGPLREIAKLMLNNLYGKFGTNPIRARKEPIYDKTKGAVY<br>VNLPAEEGDAVYIPMACFITAYSRYDLISTAQKFYKNVVYMDTDSIKFYGISR<br>EVIEAQIEVHDTKIGAWKYEGTAKMFKALRPKTYAYIDENDELDVKCAGLPKK<br>AKKDITFDTFQYGFVSKEKLEIKRVKGGTILLKTKFEIKKQVDNKHIDTEYFE<br>DEDIDIFNQL |
| Bacillus phage MG-B1 | 10 | MKKKRTKTKIKTYACDFETNTEAWLHEDKLRDELKTKEENPELWRKREAWKLH<br>TGGDKAFVWSWGGTEIREDMSFKGELDNFVVGKGISEYVDWMLDGSKNVWFHN<br>LKFDGSFIAVELLRRGFKFTFDRNPAIGEFTGLIDGKKMWFELIICKEGKRGG<br>RQFITIKDSLKKVPFGLRVAAMAFGLDVFKDDMDYDVIREPFEPIGEADYKYL<br>KKDVEITAKIIHYQVFQSGLKKTTIGSDALNEFKSTVGGDKGFKEIFPVMDFD<br>TDSFIRKSYFGGVTQVKPGMEGKLIGEGSVFDIVSMYPWVQYTKLLPYGLPIE<br>YNGEYTYDEEYPLYVQQVSFSFVVKDNMLPTIQLKKQNVEFNYNEADDVRKFN<br>GREFQKTSYGEIVTMYVTNVQWEQIQKHYWLDDLHFHKGMMFKGKIGLFKEHI<br>DKWLKVKKQANDDGNDALKSLAKLMLNSPYGKFGTNTIRLNVEPFLWEDDESL<br>GFRVEDDDPPPADPIYTAYASFVTAYAREELVSTIMMCYDRFVYCDTDSIHLI<br>GTEIPEGIKHKIGGDLGDWEPESEFKLAKFHRAKTYCEMVYAKKVMKKDRWGD<br>VVESLKHCSKEEWGTLPQDQKTLDKNLKCAGLQGHLKDYVSFEEFEIGLKINP<br>EVNKDIMGKPLGKLMPCQVKGGTLLKVRKFSLN |
| Eggerthella sp. | 11 | MNEYISDFETQKDPDTGVMSVWAWSIVDVNDLSNIQYGNNIESWLSAIQGLPN<br>GSLIGFHNLKFDGSYILSYLLGVAKWEYNDKPKARKAKTVECLISSIGVHYNY<br>RINFTKRKYVKIYDTLKIFNMSVSQIAKSFGIKEQKGSIDYAIFRGYNYTMTP<br>KEVEYITNDVKIVAKAIKQFRNEGHERNTIASNAMRYYKKNSYYSNYEFLTYF<br>PHLDDDLYHLLKRAYKGGYCYVNPKFKGKPVGHGRVYDVNSLYPSVMSDPQNK<br>YPIGTPVFFEGKYKDDPIYPLYIQFITAQFELKKGKIPTIQIKNDKRFNPREY<br>VTSTGCLMVNLYLTNVDLEMFYECYNIKEIQYIGGYKFIGRSGIFIDYVNHFK<br>EMKMQATIEKNAGKRSIAKLFLNSLYGKFGASNDKFVKRPYINDKGILAYQTV<br>ETPRPAKTVYVPVAAFVTAYARRFIQTLFIKNVDRCCYCDTDSLHLIGDDPPE<br>GVKISDTEFNCMAHESSFSRAKFLGAKLYIEEDEQGNLDVKAAGLGQNEVVKN<br>QITFDNFNTEQEYFGILKSKTVQGGVELSESTFKIRERGTRF |

TABLE 1-continued

Wild-Type Polymerase Amino Acid Sequence

| Name | SEQ ID NO. | Sequence |
|---|---|---|
| Streptococcus phage CP-7 | 12 | MTCYYAGDFETTTNEEETEVWLSCFAKVIDYDKLDTFKVNTSLEDFLKSLYLD LDKTYTETGEDEFIIFFHNLKFDGSFLLSFFLNNDIECTYFINDMGVWYSITL EFPDFTLTFRDSLKILNFSIATMAGLFKMPIAKGTTPLLKHKPDEIKPEWIDY IHVDVAILARGIFAMYYEENFSKYTSASEALTEFKRIFRKSKRKFRDFFPILD EKVDDFCRKAYRGGWTFANPKTQGRTLKQLIDIYDINSMYPATMLQNALPIGI PKRYKGKPKEIKEDHYYIYHIKADFDLKRGYLPTIQIKKKLDALRIGVRTSDY VTTSKNEVIDLYLTNFDLDLFLKHYDATIMYVETLEFQTESGLFDDYITTYRY KKENAQSPAEKQKAKIMLNSLYGKFGAKIISVKKLAYLDDKGILRFKNDDEEE VQPVYAPVALFVTSIARHFIISNAQENYDNFLYADTDSLHLFHSDSLVLDIDP SEFGKWAHEGRAVKAKYLRSKLYIEELIQEDGTTHLDVKGAGMTPEIKEKITF ENFVIGATFEGKRASKQIKGGTLIYETTFKIRETDYLV |
| Bacteroides sp. | 13 | MSKKSAKKPVIIAADFETTVYPGQTSTEVWSAAWIELFTERPHVRGNIEDFLN DIFNLNKNVLCYFHNLRFDGAFIVYWLLKNGYTWNNARNKGMNAKEFKALISD TNKWYTVTVKPKFDTVIEFRDSVKLMPMTLDQIGSAFNTKHRKLEMEYIGMRH ANCEITPEEYAYIINDIYVLKEALEVMIKSGHDKLTIGSCCMDEFKNKFDAMD FKAAFPNLKEIALIKYELGSDNVDQYIRKAYKGGYCYYKYKQRKHITQNGMTF DVNSLYPSVMHSKSGNYYPTGKPIFFEKAIPYKCLEARVYPPFYVRLRCRFKLK DGFLPTVQIKGDYKYNSTQWLETSDIYYRGKYYRYFTNKEGQKEEARPELTLF MTDYLLLLEHYDVYDLEILDGCYFHGAIGLFDTYIDHYMKIKMTTKDKGERTE AKLFLNNLYGRLAINDNSSYREPFIDPETDSIGFELHPEHEKDTLYIAAGAAV TAYARYFTITHAQANYQNFVYSDTDSIHMLDDGQPVKMIKEHATELLHWKRES DWSSAIFIRQKTYAEFVQKEDGKKVTGHWEIKCAGMPEKSKKLFLASHPITDF KIGLKVGGKLKPKYISGGMVLVEDFYTLRAKRC |
| Chlamydia trachomatis | 14 | MKARKFKIYAADFETTVFKGQTFTEVWSACFCELYKKDAKIMHSIQDFFNYFF SLNENIKMYFHNLKFDGSFILSYLLKDLKYEQAYEKMNADGSLVRWLETKDMK NNSIKYSISEMGQWYYIIIKKNNKIIEIRDSLKLLPFSLEAIGKSFDTEHKKL KMKYEGYRYAGCEITPEEQAYIKNDVLVLKEALEIMFNEKHESLTIGSCCLNE YKTIMTKFLIERLYPNIAEYTVNVPLEFKNADEYVRKSYKGGWCYLKKGCENK IYNNGTTADVNSLYSSVMHSESGNYYPVGLPTFWSGNYIPEIAKEKYYFIRIK TRFYLKKRFLPCIQVKNTYRYKSTEWLETSDFYDKKTNKYYKKYLDINGNEQN TQVILTLTMTDFELIKEHYNLVDFEILDGCYFDKEIGLFDEYINKYKKIKLNS KGAKKTLAKLYLNNLYGKTATNTDSSFKVAYIKDDLSLGFYGVYACDKKPFYI PVGSAITSYARNFTIRAAQKNYKNFIYADTDSIHCKCNPAEIKGITIDDKKFL CWKLESCWDKGLFVRQKTYIEHITAENLKPIDKPFYNVKCAGMPEQCKTLFLK SIGEDVDISDLNINDDAKEFLKKKRTIKDFKAGLSVPLKLRPVQINGGVLLTE TFYTM |
| Globodera pallida | 15 | MPLPRKKASSNGLSKRIYLADFETTTQAEDCRVWSWGLCSVENTENVEFGGDL DSFIERISEENSITFFHNLKFDGAFILDRLFRLGYEFTDEKAPQVKEFSTLIS KMGQFYSIKVRWENGMFTEFRDSLKKLPMSVKQVAKTFKLDQAKGEIDYHYLR PVGWVMTPEEREYVKNDVQIVARALKVQLQEGMTRLTVGADSLAQYKSMMGKD FERHFPVLTRTIDAEIRRAYRGGWAYADERHRGKVVGAGQTFDVNSLYPSVMY SKVLPYGEPVFYPNGLPEVTEDHPLFITCITFTAKIRDGHLPCIQIKNSSLFT PTEYVKEVLDPITMYCTNVDLELWQEHYDMDILAYNGAWLFRGIRGFFNDYID HWMRIKEESEGGRKLIAKLHLNSLYGKFATNPDVTPKIPIFDEEKDIVRLIEG PPDERNPVYTAMGVFITSYARDLTIRTAQDHYDRFLYADTDSLHLLTSDGTNN GRKSKALEVHPSKLGYWKHEYDFDAGLFVRAKAYTELMTGEFHVKSKCECDTP NDLHYQTHIAGMPEAIAQHITFESYRDGATFEGKLAPQRVPGGI |
| Potato cyst nematode | 16 | MPLPRKKASSNGLSKRIYLADFETTTQAEDCRVWSWGLCSVENTENVEFGGDL DSFIERISEENSITFFHNLKFDGAFILDRLFRLGYEFTDEKAPQVKEFSTLIS KMGQFYSIKVRWENGMFTEFRDSLKKLPMSVKQVAKTFKLDQAKGEIDYHYLR PVGWVMTPEEREYVKNDVQIVARALKVQLQEGMTRLTVGADSLAQYKSMMGKD FERHFPVLTRTIDAEIRRAYRGGWAYADERHRGKVVGAGQTFDVNSLYPSVMY SKVLPYGEPVFYPNGLPEVTEDHPLFITCITFTAKIRDGHLPCIQIKNSSLFT PTEYVKEVLDPITMYCTNVDLELWQEHYDMDILAYNGAWLFRGIRGFFNDYID HWMRIKEESEGGRKLIAKLHLNSLYGKFATNPDVTPKIPIFDEEKDIVRLIEG PPDERNPVYTAMGVFITSYARDLTIRTAQDHYDRFLYADTDSLHLLTSDGTNN GRKSKALEVHPSKLGYWKHEYDFDAGLFVRAKAYTELMTGEFHVKSKCECDTP NDLHYQTHIAGMPEAIAQHITFESYRDGATFEGKLAPQRVPGGIVLVDDTFTI K |
| Iberian lynx gut | 17 | MPSYTADFETTTVADDCRVWAWATSRIGNPDDVQLGNSIDTFLEWCRVHSGSR VYFHNLKFDGKFILHKILTDGWKKWIPDKNDCANRTFTTLISDMSQFYSIKLWF DESKSIEFLDSLKVIPLPIAAIPKAFGLEIEKLDLDYQASREVGHELTEDEKE YIAHDVKIAAMAMDTMFSQGMKKITAGSNAFADYKKTIGGKKRFRDWFPEPEY DEDLRKGGCYKGGFTAVNPKIAGKKLGKGVSFDVNSLYPSVMASSHGEVLPYG EPIPYDGGYEQDEDHPLYIQFIEADFAVKENRIPCLQLKGVNMFGETEYIRDS KGMQTLCLTSVDMEMLFEHYXXXXXXXXXXXXXXXXXXXXXXXXXXXXXXXXX XXXRTIAKLQLNSLFAANPVKQSRMPYLDEGIVKYALLEPEHAEAQYLPAGAF ITSYARQFTIRAAQANYERWLYCDTDSVYLRGTEPPVDMRVDAYELGAWKKEH EFDCFKAIRAKTYCFEEDGELTVHCAGMPARCHEHVTMDNFEVGASFPGKLKP KDVNGGTILVEDVFTIRP* |

TABLE 1-continued

Wild-Type Polymerase Amino Acid Sequence

| Name | SEQ ID NO. | Sequence |
|---|---|---|
| E. faecium (SK) | 18 | MIKKYTGDFETTTDLNDCRVWSWGVCDIDNVDNITFGLDIDSFFEWCEMQGST<br>DIYFHNEKFDGEFMLSWLFKNGFKWSKETKEERTFSTLISNMGQWYALEICWE<br>VNYTTTKSGKTKKEKVRTIIYDSLKKYPFPVKQIAEAFNFPIKKGEIDYTKER<br>PVGYNPTDDEWDYLKNDIQIMAMALKIQFDQGLTRMTRGSDALGDYKDWLKAT<br>HGKSTFKQWFPILSLGFDKDLRKAYKGGFTWVNKVFQGKEIGDGIVFDVNSLY<br>PSQMYVRPLPYGTPLFYEGEYKPNNDYPLYIQNIKVRFRLKEGYIPTIQVKQS<br>SLFIQNEYLDSSVNKLGVDELIDLTLTNVDLELFFEHYDILEIHYTYGYMFKA<br>SCDMFKGWIDKWIEVKNTTEGARKANAKGMLNSLYGKFGTNPDITGKVPYMGE<br>DGIVRLTLGEEELRDPVYVPLASFVTAWGRYTTITTAQRCFDRIIYCDTDSIH<br>LVGTDVPEAIEHLVDPKKLGYWGHESTFQRAKFIRQKTYVEEIDGELNVKCAG<br>MPDRIKELVTFDNFEVGFSSYGKLLPKRTQGGVVLVDTMFTIK |
| Bacillus phage Harambe | 19 | MGNKKRKIYSCDFETTTDVNDCRVWAYGLMEIDGKFENYKEGNNIDEFMEWTE<br>QEQGDLYFHNLRFDGEFIVNWLLHKGYRFNNTRKAGTFNAVISSMGQWYKIDI<br>YYGREGKKVFKTSIYDSLKKLPFPVKTIAKAFKLPIEKGDIDYDAPRPVGHQI<br>TPDESKYIKNDVEIIARALHSQLNTAKLTKMTIGSDALDGFKHSLHKSPKVSK<br>RMYDHHFPVISNAIHEEFKKAYRGGFTWANPKYAGKVIGNGLVFDVNSLYPSV<br>MYDKPLPYGLPVPFSGEYEYDETHPLFIQHIKCGFELKDGHIPTIQIKKNFRF<br>ADNEYLHSSEGNILDLHVTNVDLALIKEHYTLYEEEYLQGYKFKQVTGLFKNY<br>IDYWSDKKINAEDPAIRQMAKLMLNSLYGKFGTSIDVTGKEVFLKEDGSTGFR<br>KGQKEERDPVYMPMGAFITAYARDVTIRTAQKCYDRILYCDTDSIHLVGTEIP<br>EAIKDRIHDKKLGYWAHESTFWRAKFIRQKTYIEDLCMRFEGEKVNGEWKFKM<br>VEEKDITKATARELSVKCAGMPAQVKQYVTFDNFGVDFKHDPNDYTDEEIKRK<br>NIKFKLKPTHRKGGQVLVPTPFTIK |

*Sequence information unknown due to incomplete sequence coverage of gene in metagenomic shotgun sequencing In some embodiments, a wild-type polymerase sequence (e.g., as set forth in Table 1) provides a majority polymerase sequence in which one or more modifications may be made to generate a recombinant variant polymerase. As used herein, a "majority polymerase sequence" or "majority sequence" of a modified polymerase refers to a wild-type polymerase sequence that predominates within the modified polymerase sequence (e.g., where at least 50% of the amino acids in the modified polymerase sequence corresponds to amino acids in the majority sequence). In some embodiments, a modified polymerase sequence comprises a majority sequence further comprising one or more amino acid mutations. In some embodiments, one or more amino acid mutations comprise amino acids at positions corresponding to positions in homologous proteins. For example, in some embodiments, a modified polymerase comprises a mutation at a position corresponding to A484 in Φ29 polymerase (SEQ ID NO: 1). An amino acid corresponding to A484 in other polymerases can be determined by any method known in the art, including homology alignment. As a non-limiting example of this analysis, a homology alignment was conducted with a number of the polymerases reported in Table 1, and it was determined that A484 in Φ29 polymerase corresponds to A481 in M2Y, A492 in Bacillus phage VMY22, K500 in Enterococcus faecium, and K827 in Lucilia cuprina. Accordingly, homology alignments and similar methods known in the art may be used to identify amino acids in other polymerases corresponding to the positions of the modified residues described herein. Thus, it should be appreciated that the modifications of the disclosure are not intended to be limited to the polymerases described herein (e.g., those listed in Table 1), and can be extended to any polymerizing enzyme using known techniques.

In some embodiments, a modified polymerase has at least 25% amino acid sequence identity to one or more of the polymerases listed in Table 1 (e.g., to SEQ ID NO: 1, SEQ ID NO: 5, or other sequence listed in Table 1). In some embodiments, a modified polymerase has 25-50%, 50-60%, 60-70%, 70-80%, 80-90%, 90-95%, or 95-99%, or higher amino acid sequence identity to one or more of the polymerases listed in Table 1 (e.g., to SEQ ID NO: 1, SEQ ID NO: 5, or other sequence listed in Table 1). In some embodiments, such a modified polymerase includes one or more of the amino acid mutations and/or domain substitutions described in the context of different modified polymerase configurations and/or examples provided in this application.

In some embodiments, one or more segments or regions from different polymerases are described as having at least 80% amino acid sequence identity to specific sequences described in this application. Such regions can have, for example, 80-90%, 90-95%, 95-99%, or 100% sequence identity to the specified sequences (e.g., to the corresponding segments or regions in a naturally-occurring polymerase of Table 1). Also, in alternative embodiments, such segments regions can have lower sequence identity (e.g., 50-60%, 60-70%, or 70-80%) amino acid sequence identity to the specified sequences (e.g., to the corresponding segments or regions in a naturally-occurring polymerase of Table 1).

For the purposes of comparing two or more amino acid sequences, the percentage of "sequence identity" between a first amino acid sequence and a second amino acid sequence (also referred to herein as "amino acid identity") may be calculated by dividing [the number of amino acid residues in the first amino acid sequence that are identical to the amino acid residues at the corresponding positions in the second amino acid sequence] by [the total number of amino acid residues in the first amino acid sequence] and multiplying by [100%], in which each deletion, insertion, substitution or addition of an amino acid residue in the second amino acid sequence—compared to the first amino acid sequence—is considered as a difference at a single amino acid residue (position), i.e., as an "amino acid difference" as defined herein. Alternatively, the degree of sequence identity between two amino acid sequences may be calculated using a known computer algorithm (e.g., by the local homology algorithm of Smith and Waterman (1970) Adv. Appl. Math. 2:482c, by the homology alignment algorithm of Needleman and Wunsch, J. Mol. Biol. (1970) 48:443, by the search for similarity method of Pearson and Lipman. Proc. Natl. Acad. Sci. USA (1998) 85:2444, or by computerized implementations of algorithms available as Blast, Clustal Omega, or other sequence alignment algorithms) and, for example, using standard settings. Usually, for the purpose of determining the percentage of "sequence identity" between two amino acid sequences in accordance with the calculation method outlined hereinabove, the amino acid sequence with the greatest number of amino acid residues will be taken as the "first" amino acid sequence, and the other amino acid sequence will be taken as the "second" amino acid sequence.

Additionally, or alternatively, two or more sequences may be assessed for the identity between the sequences. The terms "identical" or percent "identity" in the context of two or more nucleic acids or amino acid sequences, refer to two or more sequences or subsequences that are the same. Two sequences are "substantially identical" if two sequences have a specified percentage of amino acid residues or nucleotides that are the same (e.g., at least 80%, 85%, 90%, 95%, 96%, 97%, 98%, 99%, 99.5%, 99.6%, 99.7%, 99.8% or 99.9% identical) over a specified region or over the entire sequence, when compared and aligned for maximum correspondence over a comparison window, or designated region as measured using one of the following sequence comparison algorithms or by manual alignment and visual inspection. Optionally, the identity exists over a region that is at least about 25, 50, 75, or 100 amino acids in length, or more preferably over a region that is 100 to 150, 200 or more amino acids in length.

Additionally, or alternatively, two or more sequences may be assessed for the alignment between the sequences. The terms "alignment" or percent "alignment" in the context of two or more nucleic acids or amino acid sequences, refer to two or more sequences or subsequences that are the same. Two sequences are "substantially aligned" if two sequences have a specified percentage of amino acid residues or nucleotides that are the same (e.g., at least 80%, 85%, 90%, 95%, 96%, 97%, 98%, 99%, 99.5%, 99.6%, 99.7%, 99.8% or 99.9% identical) over a specified region or over the entire sequence, when compared and aligned for maximum correspondence over a comparison window, or designated region as measured using one of the following sequence comparison algorithms or by manual alignment and visual inspection. Optionally, the alignment exists over a region that is at least about 25, 50, 75, or 100 amino acids in length, or more preferably over a region that is 100 to 150, 200 or more amino acids in length.

In some embodiments, a modified polymerase comprises one or more (e.g., 2 or more, 5 or more, 10 or more, 15 or more, 20 or more, for example all) amino acid mutations at positions corresponding to K131, K135, L142, Y148, Y224, E239, V250, L253, R306, R308, E375, A437, E466, D476, A484, E508, D510, K512, E515, K539, D570, and T571 in Φ29 polymerase. For example, in some embodiments, where a modified polymerase comprises a Φ29 polymerase majority sequence, the modified polymerase comprises one or more mutations at the positions as listed in the preceding. In some embodiments, where a modified polymerase does not comprise a Φ29 polymerase majority sequence, the modified polymerase comprises one or more amino acids that correspond to the positions listed above, e.g., as determined by homology alignment or other methods known in the art.

In some embodiments, a modified polymerase comprises mutations at one or more positions corresponding to Y148, Y226, V250, N251, T368, E375, K379, Q380, A437, P477, K478, and A484 in Φ29 polymerase. In some embodiments, a modified polymerase of the disclosure is a modified Φ29 polymerase comprising mutations at one or more of Y148, Y226, V250, N251, T368, E375, K379, Q380, A437, P477, K478, and A484. In some embodiments, the modified polymerase comprises one or more of Y148I, Y226F, V250A, N251R, T368F, E375K, K379R, Q380R, A437G, P477D, K478D, and A484C. In some embodiments, the modified polymerase comprises one or more of Y148I, Y226F, V250A, N251R, T368F, E375K, K379R, Q380R, A437G, P477D, K478D, and A484S. In some embodiments, the modified polymerase comprises one or more of Y148I, Y226F, V250A, N251R, T368F, E375K, K379R, Q380R, A437G, P477D, K478D, and A484T. In some embodiments, the modified polymerase comprises one or more of Y148I, Y226F, V250A, N251R, T368F, E375K, K379R, Q380R, A437G, P477D, K478D, and A484Q. In some embodiments, the modified polymerase comprises one or more of Y148I, Y226F, V250A, N251R, T368F, E375K, K379R, Q380R, A437G, P477D, K478D, and A484N. In some embodiments, the modified polymerase comprises one or more of Y148I, Y226F, V250A, N251R, T368F, E375K, K379R, Q380R, A437G, P477D, K478D, and A484E. In some embodiments, the modified polymerase comprises one or more of Y148I, Y226F, V250A, N251R, T368F, E375K, K379R, Q380R, A437G, P477D, K478D, and A484D. In some embodiments, the modified polymerase comprises one or more of Y148I, Y226F, V250A, N251R, T368F, E375K, K379R, Q380R, A437G, P477D, K478D, and A484K. In some embodiments, the modified polymerase comprises one or more of Y148I, Y226F, V250A, N251R, T368F, E375K, K379R, Q380R, A437G, P477D, K478D, and A484R. In some embodiments, the modified polymerase comprises one or more of Y148I, Y226F, V250A, N251R, T368F, E375K, K379R, Q380R, A437G, P477D, K478D, and A484H. In some embodiments, the modified polymerase comprises one or more of Y148I, Y226F, V250A, N251R, T368F, E375K, K379R, Q380R, A437G, P477D, K478D, and A484Y. In some embodiments, the modified polymerase comprises one or more of Y148I, Y226F, V250A, N251R, T368F, E375K, K379R, Q380R, A437G, P477D, K478D, and A484X, where X represents an unnatural amino acid, as described herein. As used herein, one or more can be 2 or more, 4 or more, 6 or more, 8 or more, 10 or more, 12 or more, for example all, of the listed amino acid substitutions.

In some embodiments, a modified polymerase comprises mutations at one or more positions (e.g., at 1-35 positions or any whole number in between, for example 2 or more, 5 or more, 10 or more, 15 or more, 20 or more, for example all) corresponding to M8, V51, N62, I71, L107, K131, K135, L142, G197, Y224, E239, V250, L253, Y281, I288, T301, R306, R308, D325, D341, K354, T368, E375, A437, A444, E466, D476, A484, E508, D510, K512, E515, K539, D570, and T571 in Φ29 polymerase. In some embodiments, a modified polymerase is a modified Φ29 polymerase comprising mutations at one or more of M8, V51, N62, I71, L107, K131, K135, L142, G197, Y224, E239, V250, L253, Y281, I288, T301, R306, R308, D325, D341, K354, T368, E375, A437, A444, E466, D476, A484, E508, D510, K512, E515, K539, D570, and T571 in Φ29 polymerase. In some embodiments, the modified polymerase comprises one or more (e.g., 1-35 or any whole number in between, for example 2 or more, 5 or more, 10 or more, 15 or more, 20 or more, for example all) of the following mutations M8R, V51A, N62D, I71V, L107I, K131E, K135Q, L142K, G197D, Y224K, E239G, V250A, V250I, L253A, L253H, Y281H, I288L, T301C, R306Q, R308L, D325E, D341E, K354R, T368F, E375Y, A437G, A444T, E466K, D476H, A484E, E508R, D510K, D510R, K512Y, E515Q, K539E, D570S, and T571V.

In some embodiments, a modified polymerase comprises mutations at one or more positions (e.g., at 1-18 positions or any whole number in between, for example 2 or more, 5 or more, 10 or more, 15 or more, for example all) corresponding to K135, L142, Y224, E239, V250, L253, E375, A437, E466, D476, A484, E508, D510, K512, E515, K539, D570, and T571 in Φ29 polymerase. In some embodiments, a modified polymerase of the disclosure is a modified Φ29 polymerase comprising mutations at one or more of K135, L142, Y224, E239, V250, L253, E375, A437, E466, D476, A484, E508, D510, K512, E515, K539, D570, and T571. In some embodiments, the modified polymerase comprises one or more (e.g., 1-18 or any whole number in between, for example 2 or more, 5 or more, 10 or more, 15 or more, for example all) of K135Q, L142K, Y224K, E239G, V250I, L253A, E375Y, A437G, E466K, D476H, A484E, E508R, D510R, K512Y, E515Q, K539E, D570S, and T571V.

In some embodiments, a modified polymerase of the present application comprises a TPR1 region substitution. For example, in some embodiments, a modified polymerase comprises a TPR1 region from E. faecium (e.g., V271-M375 in SEQ ID NO: 5) in place of a TPR1 region corresponding to S260-L359 in Φ29 polymerase (SEQ ID NO: 1).

In some embodiments, a modified polymerase of the present application comprises one or more substitutions within an exonuclease region. For example, in some embodiments, a modified polymerase comprises a portion of an exonuclease region from M2Y (e.g., M1-I51 in SEQ ID NO: 2) in place of amino acids corresponding to M1-V54 in Φ29 polymerase (SEQ ID NO: 1). In some embodiments, a modified polymerase comprises a portion of an exonuclease region from E. faecium (e.g., F72-S89 in SEQ ID NO: 5) in place of amino acids corresponding to E75-N91 in Φ29 polymerase (SEQ ID NO: 1). In some embodiments, a modified polymerase comprises the portion of the exonuclease region from M2Y and the portion of the exonuclease region from E. faecium in place of amino acids corresponding to M1-V54 and E75-N91, respectively, in Φ29 polymerase.

In some embodiments, a modified polymerase of the present application comprises a modified palm region. For example, in some embodiments, a modified polymerase comprises a portion of a palm region from E. faecium (e.g., L445-V449 in SEQ ID NO: 5) in place of amino acids corresponding to M429-I433 in Φ29 polymerase (SEQ ID NO: 1). In some embodiments, a modified polymerase comprises an alanine to thymine mutation at a position corresponding to A444 in Φ29 polymerase (e.g., A444T). In some embodiments, a modified polymerase comprises the portion of the palm region from E. faecium and an amino acid mutation corresponding to A444T in Φ29 polymerase.

In some embodiments, a modified polymerase comprises mutations at one or more positions (e.g., 1, 2, or 3) corresponding to G197, I71, and L107 in Φ29 polymerase. In some embodiments, a modified polymerase of the disclosure is a modified Φ29 polymerase comprising mutations at one or more (e.g., 1, 2, or 3) of G197, I71, and L107. In some embodiments, the modified polymerase comprises one or more (e.g., 1, 2, or 3) of G197D, I71V, and L107I.

In some embodiments, a modified polymerase of the present application comprises one or more amino acid mutations in one or more regions or segments (e.g., domains or portions thereof, optionally including flanking amino acids) of the polymerase. In some embodiments, the modified polymerase comprises one or more amino acid mutations in one or more of an exonuclease region, a palm region, a TPR1 region, a fingers region, a TPR2 region, and a thumb region.

In some embodiments, a modified polymerase comprises mutations at one or more positions in an exonuclease region (e.g., an exonuclease loop of an exonuclease region). In some embodiments, a modified polymerase having a Φ29 polymerase majority sequence comprises mutations at one or more positions in an exonuclease region. For example, in some embodiments, a modified polymerase of the disclosure is a modified Φ29 polymerase comprising mutations at one or more of E75, R76, S82, A83, D84, G85, L86, P87, N88, Y90, and N91 in an exonuclease region of Φ29 polymerase. In some embodiments, a modified polymerase comprises one or more amino acid mutations at positions corresponding to E75, R76, S82, A83, D84, G85, L86, P87, N88, Y90, and N91 in Φ29 polymerase. Accordingly, in some embodiments, where a modified polymerase does not comprise a Φ29 polymerase majority sequence, the modified polymerase comprises one or more amino acids that correspond to the positions listed above, e.g., as determined by homology alignment or other methods known in the art. In some embodiments, the modified polymerase comprises one or more of E75F, R76K, S82C, A83K, D84E, G85A, L86K, P87E, N88R, Y90F, and N91S. Accordingly, in some embodiments, a segment comprising an exonuclease domain or portion thereof is swapped for a corresponding exonuclease domain from a different polymerase. For example, in some embodiments, a segment comprising a loop and flanking amino acids of an exonuclease domain of one polymerase are replaced with a corresponding segment from another polymerase. For example, in some embodiments, a Φ29 E75-N91 segment is replaced with a corresponding F72-S89 segment form E. faecium. In some embodiments, swapping a segment comprising an exonuclease loop can reduce the interpulse distance of a polymerase.

In some embodiments, a modified polymerase comprises mutations at one or more positions in a TPR1 region. For example, in some embodiments, a modified polymerase comprises mutations at one or more (e.g., 1, 2, 3, 4, 5, or 6) positions corresponding to Y281, I288, T301, D325, D341, and K354 in Φ29 polymerase. In some embodiments, a modified polymerase of the disclosure is a modified Φ29 polymerase comprising mutations at one or more (e.g., 1, 2, 3, 4, 5, or 6) of Y281, I288, T301, D325, D341, and K354. In some embodiments, amino acids at one or more (e.g., 1, 2, 3, 4, 5, or 6) of Y281, I288, T301, D325, D341, and K354 are changed to amino acids at corresponding positions in other polymerases (e.g., M2Y, Lucilia cuprina, a Bacillus strain, for example GA-1). In some embodiments, the modified polymerase comprises one or more (e.g., 1, 2, 3, 4, 5, or 6) of Y281H, I288L, T301C, D325E, D341E, and K354R. In some embodiments, mutations at one or more (e.g., 1, 2, 3, 4, 5, or 6) positions corresponding to Y281, I288, T301, D325, D341, and K354 in Φ29 polymerase increase rate of incorporation (e.g., in a single molecule sequencing reaction).

In some embodiments, a modified polymerase comprises mutations at one or more positions in a palm region. For example, in some embodiments, a modified polymerase comprises mutations at one or more (e.g., 1, 2, 3, 4, or 5) positions corresponding to M429, G430, V431, I433, and A444 in Φ29 polymerase. In some embodiments, a modified polymerase of the disclosure is a modified Φ29 polymerase comprising mutations at one or more (e.g., 1, 2, 3, 4, or 5) of M429, G430, V431, I433, and A444. In some embodiments, amino acids at one or more (e.g., 1, 2, 3, 4, or 5) of M429, G430, V431, I433, and A444 are changed to amino acids at corresponding positions in other polymerases (e.g., M2Y, *Lucilia cuprina*, a *Bacillus* strain, for example GA-1). In some embodiments, the modified polymerase comprises one or more (e.g., 1, 2, 3, 4, or 5) of M429L, G430A, V431S, I433V, and A444T. In some embodiments, mutations at one or more (e.g., 1, 2, 3, 4, or 5) positions corresponding to M429, G430, V431, I433, and A444 in Φ29 polymerase increase accuracy (e.g., in a single molecule sequencing reaction).

In some embodiments, a modified polymerase comprises mutations at one or more positions in a palm region and at one or more positions in an exonuclease region. For example, in some embodiments, a modified polymerase comprises mutations at one or more (e.g., 1, 2, or 3) positions corresponding to G197, M8, and V51 in Φ29 polymerase. In some embodiments, a modified polymerase of the disclosure is a modified Φ29 polymerase comprising mutations at one or more (e.g., 1, 2, or 3) of G197, M8, and V51. In some embodiments, the modified polymerase comprises one or more (e.g., 1, 2, or 3) of G197D, M8R, and V51A. In some embodiments, mutations at one or more (e.g., 1, 2, or 3) positions corresponding to G197, M8, and V51 in Φ29 polymerase can improve production yield, thermostability, and/or improve efficiency of loading (e.g., loading into sample wells of an array).

In some embodiments, a modified polymerase comprises mutations at one or more positions in a palm region and at one or more positions in a thumb region. For example, in some embodiments, a modified polymerase comprises mutations at one or more (e.g., 1, 2, 3, 4, or 5) positions corresponding to E466, D476, K539, D570, and T571 in Φ29 polymerase. In some embodiments, a modified polymerase of the disclosure is a modified Φ29 polymerase comprising mutations at one or more (e.g., 1, 2, 3, 4, or 5) of E466, D476, K539, D570, and T571. In some embodiments, the modified polymerase comprises one or more (e.g., 1, 2, 3, 4, or 5) of E466K, D476H, K539E, D570S, and T571V.

In some embodiments, a modified polymerase comprises one or more (e.g., 1, 2, 3, 4, 5, 6, or 7) amino acid mutations at positions corresponding to N59, Y145, V247, L250, E372, A481, and K509 in M2Y polymerase. For example, in some embodiments, where a modified polymerase comprises an M2Y polymerase majority sequence, the modified polymerase comprises one or more mutations at the positions as listed in the preceding. In some embodiments, where a modified polymerase does not comprise an M2Y polymerase majority sequence, the modified polymerase comprises one or more amino acid mutations that correspond to the positions listed above, e.g., as determined by homology alignment or other methods known in the art.

In some embodiments, a modified polymerase comprises one or more segments (e.g., domains or portions thereof, optionally including flanking amino acids) of a wild-type polymerase (e.g., as set forth in Table 1). In some embodiments, one or more segments (e.g., domains or portions thereof, optionally including flanking amino acids) of an *Enterococcus faecium* polymerase (e.g., one or more segments of SEQ ID NO: 5) can be substituted for one or more segments of any of SEQ ID NOs: 1-4, and 6-19. In some embodiments, one or more segments (e.g., domains or portions thereof, optionally including flanking amino acids) of an *Enterococcus faecium* polymerase can be substituted for one or more segments of a Φ29 polymerase. In some embodiments, one or more segments (e.g., domains or portions thereof, optionally including flanking amino acids) of an *Enterococcus faecium* polymerase can be substituted for one or more segments of an M2Y polymerase. In some embodiments, one or more segments (e.g., domains or portions thereof, optionally including flanking amino acids) of an *Enterococcus faecium* polymerase can be substituted for one or more segments of a Φ29 polymerase and/or an M2Y polymerase. In some embodiments, one or more segments (e.g., domains or portions thereof, optionally including flanking amino acids) of an *Enterococcus faecium* polymerase (e.g., a domain of SEQ ID NO: 5 or a modified form thereof, e.g., containing one or more amino acid substitutions) can be substituted for one or more segments of a variant polymerase described herein (e.g., of a variant polymerase listed in Table 2, or a variant polymerase containing one or more amino acid substitutions or other domain substitutions illustrated in Table 2 or described in Tables 3-5).

In some embodiments, the majority sequence of a modified polymerase does not comprise one or more homologous amino acids that correspond to the positions in the polymerases listed above as examples. In such instances, in some embodiments, the modified polymerase does not comprise the one or more mutations. However, in some embodiments, where surrounding homologous residues are identifiable when comparing a desired amino acid sequence to a polymerase sequence described herein, the mutated amino acids are included in the modified polymerase as an insertion at a site in the polymerase that is inferred based on the surrounding homologous residues. Mutated polymerase variants were engineered in accordance with embodiments described herein and are listed in Table 2 (SEQ ID NOs: 20-96).

TABLE 2

Homologous Polymerase Variants

| Name | SEQ ID NO | Sequence |
|---|---|---|
| H008 | 20 | MSRKMFSCDFETTTKLDDCRVWAYGYMEIGNLDNYKIGNSLDEFMQWVMEIQADLYFH<br>NLKFDGAFIVNWLEQHGFKWSNEGLPNTYNTIISKMGQWYMIDICFGYKGKRKLHTVI<br>YDSLKKLPFPVKKIAKDFQLPLLKGDIDIHTERPVGHEITPEEYEYIKNDIEIIARAL<br>DIQFKQGLDRMTAGSDSLKGFKDILSTKKFNKVFPKLSLPMDKEIRKAYRGGFTWLND<br>KYKEKEIGEGMVFDVNSLYPSQMYSRPLPYGAPIVFQGKYEKDEQYPLYIQRIRFEFE<br>LKEGYIPTIQIKKNPFFKGNEYLKNSGVEPVELYLTNVDLELIQEHYELYNVEYIDGF<br>KFREKTGLFKDFIDKWTYVKTHEEGAKKQLAKLMLNSLYGKFASNPDVTGKVPYLKDD<br>GSLGFRVGDEEYKDPVYTPMGVFITAWARFTTITAAQACYDRIIYCDTDSIHLTGTEV<br>PEIIKDIVDPKKLGYWEHESTFKRAKYLRQKTYIQDIYVKEVDGKLKECSPDEATTTK<br>FSVKCAGMTDTIKKKVTFDNFAVGFSSMGKPKPVQVNGGVVLVDSVFTIK |

TABLE 2-continued

Homologous Polymerase Variants

| Name | SEQ ID NO | Sequence |
|---|---|---|
| H009 | 21 | MSRKMFSCDFETTTKLDDCRVWAYGYMEIGNLDNYKIGNSLDEFMQWVMEIQADLYFH<br>NLKFDGAFIVNWLEQHGFKWSNEGLPNTYNTIISKMGQWYMIDICFGYKGKRKLHTVI<br>YDSLKKLPFPVKKIAKDFQLPLLKGDIDIHTERPVGHEITPEEYEYIKNDIEIIARAL<br>DIQFKQGLDRMTAGSDSLKGFKDILSTKKFNKVFPKLSLPMDKEIRKAYRGGFTWLND<br>KYKEKEIGEGMVFDANSAYPSQMYSRPLPYGAPIVFQGKYEKDEQYPLYIQRIRFEFE<br>LKEGYIPTIQIKKNPFFKGNEYLKNSGVEPVELYLTNVDLELIQEHYELYNVEYIDGF<br>KFREKTGLFKDFIDKWTYVKTHEEGAKKQLAKLMLNSLYGKFASNPDVTGKVPYLKDD<br>GSLGFRVGDEEYKDPVYTPMGVFITAWARFTTITAAQACYDRIIYCDTDSIHLTGTEV<br>PEIIKDIVDPKKLGYWEHESTFKRAKYLRQKTYIQDIYVKEVDGKLKECSPDEATTTK<br>FSVKCAGMTDTIKKKVTFDNFAVGFSSMGKPKPVQVNGGVVLVDSVFTIK |
| H010 | 22 | MSRKMFSCDFETTTKLDDCRVWAYGYMEIGNLDNYKIGNSLDEFMQWVMEIQADLYFH<br>NLKFDGAFIVNWLEQHGFKWSNEGLPNTYNTIISKMGQWYMIDICFGYKGKRKLHTVI<br>YDSLKKLPFPVKKIAKDFQLPLLKGDIDIHTERPVGHEITPEEYEYIKNDIEIIARAL<br>DIQFKQGLDRMTAGSDSLKGFKDILSTKKFNKVFPKLSLPMDKEIRKAYRGGFTWLND<br>KYKEKEIGEGMVFDANSAYPSQMYSRPLPYGAPIVFQGKYEKDEQYPLYIQRIRFEFE<br>LKEGYIPTIQIKKNPFFKGNEYLKNSGVEPVELYLTNVDLELIQEHYELYNVEYIDGF<br>KFREKTGLFKDFIDKWTYVKTHEYGAKKQLAKLMLNSLYGKFASNPDVTGKVPYLKDD<br>GSLGFRVGDEEYKDPVYTPMGVFITAWARFTTITAAQACYDRIIYCDTDSIHLTGTEV<br>PEIIKDIVDPKKLGYWEHESTFKRAKYLRQKTYIQDIYVKEVDGYLKECSPDEATTTK<br>FSVKCAGMTDTIKKKVTFDNFAVGFSSMGKPKPVQVNGGVVLVDSVFTIK |
| H011 | 23 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDILSTKKFNKVFPKLSLPMDKEIRKAYRGGFTWLND<br>KYKEKEIGEGMVFDANSAYPSQMYSRPLPYGAPIVFQGKYEKDEQYPLYIQRIRFEFE<br>LKEGYIPTIQIKKNPFFKGNEYLKNSGVEPVELYLTNVDLELIQEHYELYNVEYIDGF<br>KFREKTGLFKDFIDKWTYVKTHEYGAKKQLAKLMLNSLYGKFASNPDVTGKVPYLKDD<br>GSLGFRVGDEEYKDPVYTPMGVFITAWARFTTITAAQACYDRIIYCDTDSIHLTGTEV<br>PEIIKDIVDPKKLGYWEHESTFKRAKYLRQKTYIQDIYVKEVDGYLKECSPDEATTTK<br>FSVKCAGMTDTIKKKVTFDNFAVGFSSMGKPKPVQVNGGVVLVDSVFTIK |
| H012 | 24 | MIKKYTGDFETTTDLNDCRVWSWGVCDIDNVDNITFGLEIDSFFEWCEMQGSTDIYFH<br>NEKFDGEFMLSWLFKNGFKWCKEAKEERTFSTLISNMGQWYALEICWNVKCTTTKTGK<br>TKKEKQRTIIYDSLKKYPFPVKEIAEAFNFPIKKGEIDITKERPIGYNPTDDEWDYLK<br>NDIQIMAMALKIQFDQGLTRMTRGSDALGDYQDWVKTTYGKSRFKQWFPVLSLGFDKD<br>LRKAYKGGFTWVNKVFQGKEIGEGIVFDVNSLYPSQMYVRPLPYGTPLFYEGEYKENI<br>DYPLYIQNIKVRFRLKERHIPTIQVKQSSLFIQNEYLESSVNKLGVDELIDLTLTNVD<br>LDLFFEHYDILEIHYTYGYMFKASCDMFKGWIDKWIEVKNTTEGARKANAKGMLNSLY<br>GKFGTNPDITGKVPYMGEDGIVRLTLGEEELRDPVYVPLASFVTAWGRYTTITTAQRC<br>FDNIIYCDTDSIHLTGTEVPEAIEHLVDSKKLGYWEHESTFQRAKFIRQKTYVEEIDG<br>ELNVKCAGMPDRIKELVTFDNFEVGFSSYGKLLPKRTQGGVVLVDTMFTIK |
| H013 | 25 | MIKKYTGDFETTTDLNDCRVWSWGVCDIDNVDNITFGLEIDSFFEWCEMQGSTDIYFH<br>NEKFDGEFMLSWLFKNGFKWCKEAKEERTFSTLISNMGQWYALEICWNVKCTTTKTGK<br>TKKEKQRTIIYDSLKKYPFPVKEIAEAFNFPIKKGEIDITKERPIGYNPTDDEWDYLK<br>NDIQIMAMALKIQFDQGLTRMTRGSDALGDYQDWVKTTYGKSRFKQWFPVLSLGFDKD<br>LRKAYKGGFTWVNKVFQGKEIGEGIVFDANSYPSQMYVRPLPYGTPLFYEGEYKENI<br>DYPLYIQNIKVRFRLKERHIPTIQVKQSSLFIQNEYLESSVNKLGVDELIDLTLTNVD<br>LDLFFEHYDILEIHYTYGYMFKASCDMFKGWIDKWIEVKNTTEGARKANAKGMLNSLY<br>GKFGTNPDITGKVPYMGEDGIVRLTLGEEELRDPVYVPLASFVTAWGRYTTITTAQRC<br>FDNIIYCDTDSIHLTGTEVPEAIEHLVDSKKLGYWEHESTFQRAKFIRQKTYVEEIDG<br>ELNVKCAGMPDRIKELVTFDNFEVGFSSYGKLLPKRTQGGVVLVDTMFTIK |
| H014 | 26 | MIKKYTGDFETTTDLNDCRVWSWGVCDIDNVDNITFGLEIDSFFEWCEMQGSTDIYFH<br>NEKFDGEFMLSWLFKNGFKWCKEAKEERTFSTLISNMGQWYALEICWNVKCTTTKTGK<br>TKKEKQRTIIYDSLKKYPFPVKEIAEAFNFPIKKGEIDITKERPIGYNPTDDEWDYLK<br>NDIQIMAMALKIQFDQGLTRMTRGSDALGDYQDWVKTTYGKSRFKQWFPVLSLGFDKD<br>LRKAYKGGFTWVNKVFQGKEIGEGIVFDANSYPSQMYVRPLPYGTPLFYEGEYKENI<br>DYPLYIQNIKVRFRLKERHIPTIQVKQSSLFIQNEYLESSVNKLGVDELIDLTLTNVD<br>LDLFFEHYDILEIHYTYGYMFKASCDMFKGWIDKWIEVKNTTYGARKANAKGMLNSLY<br>GKFGTNPDITGKVPYMGEDGIVRLTLGEEELRDPVYVPLASFVTAWGRYTTITTAQRC<br>FDNIIYCDTDSIHLTGTEVPEAIEHLVDSKKLGYWEHESTFQRAKFIRQKTYVEEIDG<br>ELNVKCAGMPDRIKELVTFDNFEVGFSSYGKLLPKRTQGGVVLVDTMFTIK |
| H016 | 27 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDIHTERPVGHEITPEEYEYIKNDIEIIARAL<br>DIQFKQGLDRMTAGSDSLKGFKDILSTKKFNKVFPKLSLPMDKEIRKAYRGGFTWLND<br>KYKGKEIGEGMVFDINSAYPSQMYSRPLPYGAPIVFQGKYEKDEQYPLYIQRIRFEFE<br>LKEGYIPTIQIKKNPFFKGNEYLKNSGVEPVELYLTNVDLELIQEHYELYNVEYIDGF<br>KFREKTGLFKDFIDKWTYVKTHEYGAKKQLAKLMLNSLYGKFASNPDVTGKVPYLKDD |

TABLE 2-continued

Homologous Polymerase Variants

| Name | SEQ ID NO | Sequence |
|---|---|---|
| | | GSLGFRVGDEEYKDPVYTPMGVFITAWGRFTTITAAQACYDRIIYCDTDSIHLTGTEV<br>PEIIKDIVDPKKLGYWEHESTFKRAKYLRQKTYIQDIYVKEVKGYLKQCSPDEATTTK<br>FSVKCAGMTDTIKKKVTFDNFAVGFSSMGKPKPVQVNGGVVLVDSVFTIK |
| H018 | 28 | MKHMPRKMYSCDFETTTDVNDCRVWAYGWMEIGKTSNYKIGTDFNEFMEWMIHSSSRL<br>YFHDLKFDGSFIVNWLLHNGYTWTKRPSKEGQFSTLISKMGQWYGITICSGRDGRKKK<br>LTTIHDSLKKLPFPVRKIGKDFKLNVLKGDIDIHKPRPIGYEIDDEEYQYIKNDIQII<br>AEALEVQTVQGLTGMTNGKDALDEFVNMSGKLYEKLFPVFSLELNEEIRKAYRGGFTW<br>LNPVYGGKKYVKDGIVFDANSAYPSQMYDRDLPCGVPIPFEGEYVYDKSHPLYIQKLT<br>FEFELKENYIPTIQLKNSRFGFKGNEYLSSSNGERITISVSSVDWELIREHYHVYDVE<br>FEKGWKFRSTKQAFRQYIDKWMLVKNMSYGAKKAIAKLMLNSLYGKFATNPDITGKRP<br>YLREDGSNGFELMEEEFRDPVYTPVGIFITSWARYTTITSAQKCYDRIIYCDTDSMHL<br>EGLDVPESIKDIVADDVLGYWEKEGQFKQGKFIRQKTYMEEYYAKYVRDENGEIKYDD<br>EKPYKTICDKEESDTTIIEIKCAGMPDNIKKHVTFDNFDIGFTMEGKLKPKQVYGGVV<br>LVEETYTMK |
| H020 | 29 | MIKKYTGDFETTTDLNDCRVWSWGVCDIDNVDNITFGLEIDSFFEWCEMQGSTDIYFH<br>DEKFDGEFMLSWLFKNGFKWCKEAKEERTFSTLISNMGQWYALEICWNVKCTTTKTGK<br>TKKEKQRTIIYDSLKKYPFPVKEIAEAFNFPIKKGEIDITKERPIGYNPTDDEWDYLK<br>NDIQIMAMALKIQFDQGLTRMTRGSDALGDYQDWVKTTYGKSRFPKWFPVLSLGFDKD<br>LRKAYKGGFTWVNKVFQGKEIGEGIVFDANSAYPSQMYVRPLPYGTPLFYEGEYKENI<br>DYPLYIQNIKVRFRLKERHIPTIQVKQSSLFIQNEYLESSVNKLGVDELIDLTLTNVD<br>LDLFFEHYDILEIHYTYGYMFKASCDMFKGWIDKWIEVKNTTYGARKANAKGMLNSLY<br>GKFGTNPDITGKVPYMGEDGIVRLTLGEEELRDPVYVPLASFVTAWGRYTTITTAQRC<br>FDNIIYCDTDSIHLTGTEVPEAIEHLVDSKKLGYWEHESTFQRAKFIRQKTYVEEIDG<br>ELNVKCAGMPDRIKELVTFDNFEVGFSSYGKLLPKRTQGGVVLVDTMFTIK |
| H022 | 30 | MATKKRKAYSCDFEATTSTYSETETRVWAYGWMEIGNTSHFNIGDNLDEFMLWTSKEC<br>ADLYFHDLRYDGEFIVNWLLHKGYECNESGRPKTFDTVISKGGQWYKIAIHHEGKGTT<br>QIFDSLKKLPFPVKTIAKAFKLPVLKGDIDINLHRDENHVITSEEFTYIKHDIEIVAR<br>ALDIQINQQGLVKMTNGADSMDHFIKSLDKKKKVAERIYNQYFPKMSIAMDSIFRKAY<br>RGGFTWVNPKFKGQEVGEGMVFDANSAYPSVMYYKPLPWGKPVPFVGKYEEDPDFPLY<br>ICHIKTGFVLKEGHIPTIQIKKNPIFQENEYLETSGGAPVDLHVTNVDLELIKEHYEL<br>YDTEYVGGWKFRQQTGIFNNFIDYWMKIKTDPKSTPAIVTLAKLQLNSLYGKFASHPD<br>VTGKVPYLKDDGSTAFKKGLPKSKDPVYTPAGAFITAWARHMTITTAQKVYDRILYCD<br>TDSIHILGIDIPEAIKNDIHQKELGKWEFECMFKRAKFVRQKTYVEDMYAKFMKYWED<br>GELNYYLKECVKEEATARLLNVKCAGMPQAVKKFVTFRTFAVGFTSDTGKLKPKHVKG<br>GQILVDVPFTIK |
| H025 | 31 | MIKKYTGDFETTTDLNDCRVWSWGVCDIDNVDNITFGLEIDSFFEWCEMQGSTDIYFH<br>NEKFDGEFMLSWLFKNGFKWCKEAKEERTFSTLISNMGQWYALEICWNVKCTTTKTGK<br>TKKEKQRTIIYDSLKKYPFPVKEIAEAFNFPIKKGEIDYTKERPIGYNPTDDEWDYLK<br>NDIQIMAMALKIQFDQGLTRMTRGSDALGDYQDWVKTTYGKSRFKQWFPVLSLGFDKD<br>LRKAYKGGFTWVNKVFQGKEIGEGIVFDVNSLYPSQMYVRPLPYGTPLFYEGEYKENI<br>DYPLYIQNIKVRFRLKERHIPTIQVKQSSLFIQNEYLESSVNKLGVDELIDLTLTNVD<br>LDLFFEHYDILEIHYTYGYMFKASCDMFKGWIDKWIEVKNTTEGARKANAKGMLNSLY<br>GKFGTNPDITGKVPYMGEDGIVRLTLGEEELRDPVYVPLASFVTAWGRYTTITTAQRC<br>FDNIIYCDTDSIHLTGTEVPEAIEHLVDSKKLGYWKHESTFQRAKFIRQKTYVEEIDG<br>ELNVKCAGMPDRIKELVTFDNFEVGFSSYGKLLPKRTQGGVVLVDTMFTIK |
| H026 | 32 | MIKKYTGDFETTTDLNDCRVWSWGVCDIDNVDNITFGLEIDSFFEWCEMQGSTDIYFH<br>NEKFDGEFMLSWLFKNGFKWCKEAKEERTFSTLISNMGQWYALEICWNVKCTTTKTGK<br>TKKEKQRTIIYDSLKKYPFPVKEIAEAFNFPIKKGEIDITKERPIGYNPTDDEWDYLK<br>NDIQIMAMALKIQFDQGLTRMTRGSDALGDYQDWVKTTYGKSRFKQWFPVLSLGFDKD<br>LRKAYKGGFTWVNKVFQGKEIGEGIVFDVNSLYPSQMYVRPLPYGTPLFYEGEYKENI<br>DYPLYIQNIKVRFRLKERHIPTIQVKQSSLFIQNEYLESSVNKLGVDELIDLTLTNVD<br>LDLFFEHYDILEIHYTYGYMFKASCDMFKGWIDKWIEVKNTTEGARKANAKGMLNSLY<br>GKFGTNPDITGKVPYMGEDGIVRLTLGEEELRDPVYVPLASFVTAWGRYTTITTAQRC<br>FDNIIYCDTDSIHLTGTEVPEAIEHLVDSKKLGYWKHESTFQRAKFIRQKTYVEEIDG<br>ELNVKCAGMPDRIKELVTFDNFEVGFSSYGKLLPKRTQGGVVLVDTMFTIK |
| H027 | 33 | MIKKYTGDFETTTDLNDCRVWSWGVCDIDNVDNITFGLEIDSFFEWCEMQGSTDIYFH<br>NEKFDGEFMLSWLFKNGFKWCKEAKEERTFSTLISNMGQWYALEICWNVKCTTTKTGK<br>TKKEKQRTIIYDSLKKYPFPVKEIAEAFNFPIKKGEIDITKERPIGYNPTDDEWDYLK<br>NDIQIMAMALKIQFDQGLTRMTRGSDALGDYQDWVKTTYGKSRFKQWFPVLSLGFDKD<br>LRKAYKGGFTWVNKVFQGKEIGEGIVFDVNSLYPSQMYVRPLPYGTPLFYEGEYKENI<br>DYPLYIQNIKVRFRLKERHIPTIQVKQSSLFIQNEYLESSVNKLGVDELIDLTLTNVD<br>LDLFFEHYDILEIHYTYGYMFKASCDMFKGWIDKWIEVKNTTEGARKANAKGMLNSLY<br>GKFGTNPDITGKVPYMGEDGIVRLTLGEEELRDPVYVPLASFVTAWGRYTTITTAQRC<br>FDNIIYCDTDSIHLTGTEVPEAIEHLVDSKKLGYWKHESTFQRAKFIRQKTYVEEIDG<br>ELNVKCAGMPDRIKELVTFDNFEVGFSSYGKLLPKRTQGGVVLVDTMFTIK |
| H028 | 34 | MIKKYTGDFETTTDLNDCRVWSWGVCDIDNVDNITFGLEIDSFFEWCEMQGSTDIYFH<br>NEKFDGEFMLSWLFKNGFKWCKEAKEERTFSTLISNMGQWYALEICWNVKCTTTKTGK<br>TKKEKQRTIIYDSLKKYPFPVKEIAEAFNFPIKKGEIDITKERPIGYNPTDDEWDYLK |

TABLE 2-continued

Homologous Polymerase Variants

| Name | SEQ ID NO | Sequence |
|---|---|---|
| | | NDIQIMAMALKIQFDQGLTRMTRGSDALGDYQDWVKTTYGKSRFKQWFPVLSLGFDKD LRKAYKGGFTWVNKVFQGKEIGEGIVFDANSHYPSQMYVRPLPYGTPLFYEGEYKENI DYPLYIQNIKVRFRLKERHIPTIQVKQSSLFIQNEYLESSVNKLGVDELIDLTLTNVD LDLFFEHYDILEIHYTYGYMFKASCDMFKGWIDKWIEVKNTTEGARKANAKGMLNSLY GKFGTNPDITGKVPYMGEDGIVRLTLGEEELRDPVYVPLASFVTAWGRYTTITTAQRC FDNIIYCDTDSIHLTGTEVPEAIEHLVDSKKLGYWKHESTFQRAKFIRQKTYVEEIDG ELNVKCAGMPDRIKELVTFDNFEVGFSSYGKLLPKRTQGGVVLVDTMFTIK |
| H029 | 35 | MIKKYTGDFETTTDLNDCRVWSWGVCDIDNVDNITFGLEIDSFFEWCEMQGSTDIYFH NEKFDGEFMLSWLFKNGFKWCKEAKEERTFSTLISNMGQWYALEICWNVKCTTTKTGK TKKEKQRTIIYDSLKKYPFPVKEIAEAFNFPIKKGEIDITKERPIGYNPTDDEWDYLK NDIQIMAMALKIQFDQGLTRMTRGSDALGDYQDWVKTTYGKSRFKQWFPVLSLGFDKD LRKAYKGGFTWVNKVFQGKEIGEGIVFDANSAYPSQMYVRPLPYGTPLFYEGEYKENI DYPLYIQNIKVRFRLKERHIPTIQVKQSSLFIQNEYLESSVNKLGVDELIDLTLTNVD LDLFFEHYDILEIHYTYGYMFKASCDMFKGWIDKWIEVKNTTEGARKANAKGMLNSLY GKFGTNPDITGKVPYMGEDGIVRLTLGEEELRDPVYVPLASFVTAWGRYTTITTAQRC FDNIIYCDTDSIHLTGTEVPEAIEHLVDSKKLGYWKHESTFQRAKFIRQKTYVEEIDG ELNVKCAGMPDRIKELVTFDNFEVGFSSYGKLLPKRTQGGVVLVDTMFTIK |
| H030 | 36 | MIKKYTGDFETTTDLNDCRVWSWGVCDIDNVDNITFGLEIDSFFEWCEMQGSTDIYFH NEKFDGEFMLSWLFKNGFKWCKEAKEERTFSTLISNMGQWYALEICWNVKCTTTKTGK TKKEKQRTIIYDSLKKYPFPVKEIAEAFNFPIKKGEIDITKERPIGYNPTDDEWDYLK NDIQIMAMALKIQFDQGLTRMTRGSDALGDYQDWVKTTYGKSRFKQWFPVLSLGFDKD LRKAYKGGFTWVNKVFQGKEIGEGIVFDANSHYPSQMYVRPLPYGTPLFYEGEYKENI DYPLYIQNIKVRFRLKERHIPTIQVKQSSLFIQNEYLESSVNKLGVDELIDLTLTNVD LDLFFEHYDILEIHYTYGYMFKASCDMFKGWIDKWIEVKNTTYGARKANAKGMLNSLY GKFGTNPDITGKVPYMGEDGIVRLTLGEEELRDPVYVPLASFVTAWGRYTTITTAQRC FDNIIYCDTDSIHLTGTEVPEAIEHLVDSKKLGYWKHESTFQRAKFIRQKTYVEEIDG ELNVKCAGMPDRIKELVTFDNFEVGFSSYGKLLPKRTQGGVVLVDTMFTIK |
| H031 | 37 | MIKKYTGDFETTTDLNDCRVWSWGVCDIDNVDNITFGLEIDSFFEWCEMQGSTDIYFH NEKFDGEFMLSWLFKNGFKWCKEAKEERTFSTLISNMGQWYALEICWNVKCTTTKTGK TKKEKQRTIIYDSLKKYPFPVKEIAEAFNFPIKKGEIDITKERPIGYNPTDDEWDYLK NDIQIMAMALKIQFDQGLTRMTRGSDALGDYQDWVKTTYGKSRFKQWFPVLSLGFDKD LRKAYKGGFTWVNKVFQGKEIGEGIVFDANSHYPSQMYVRPLPYGTPLFYEGEYKENI DYPLYIQNIKVRFRLKERHIPTIQVKQSSLFIQNEYLESSVNKLGVDELIDLTLTNVD LDLFFEHYDILEIHYTYGYMFKASCDMFKGWIDKWIEVKNTTYGARKANAKGMLNSLY GKFGTNPDITGKVPYMGEDGIVRLTLGEEELRDPVYVPLASFVTAWGRYTTITTAQRC FDNIIYCDTDSIHLTGTEVPEAIEHLVDSKKLGYWEHESTFQRAKFIRQKTYVEEIDG ELNVKCAGMPDRIKELVTFDNFEVGFSSYGKLLPKRTQGGVVLVDTMFTIK |
| H032 | 38 | MIKKYTGDFETTTDLNDCRVWSWGVCDIDNVDNITFGLEIDSFFEWCEMQGSTDIYFH NEKFDGEFMLSWLFKNGFKWCKEAKEERTFSTLISNMGQWYALEICWNVKCTTTKTGK TKKEKQRTIIYDSLKKYPFPVKEIAEAFNFPIKKGEIDITKERPIGYNPTDDEWDYLK NDIQIMAMALKIQFDQGLTRMTRGSDALGDYQDWVKTTYGKSRFKQWFPVLSLGFDKD LRKAYKGGFTWVNKVFQGKEIGEGIVFDANSHYPAQMYVRPLPYGTPLFYEGEYKENI DYPLYIQNIKVRFRLKERHIPTIQVKQSSLFIQNEYLESSVNKLGVDELIDLTLTNVD LDLFFEHYDILEIHYTYGYMFKASCDMFKGWTEVKTTTYGARKQLAKLMLNSLY GKFGTNPDITGKVPYMGEDGIVRLTLGEEELRDPVYVPLASFVTAWGRYTTITTAQRC FDNIIYCDTDSIHLTGTEVPEAIEHLVDPKKLGYWEHESTFKRAKFIRQKTYVEEIDG ELNVKCAGMPDRIKELVTFDNFEVGFSSYGKLLPKRTQGGVVLVDTMFTIK |
| H033 | 39 | MIKKYTGDFETTTDLNDCRVWSWGVCDIDNVDNITFGLEIDSFFEWCEMQGSTDIYFH NEKFDGEFMLSWLFKNGFKWCKEAKEERTFSTLISNMGQWYALEICWNVKCTTTKTGK TKKEKQRTIIYDSLKKYPFPVKEIAEAFNFPIKKGEIDITKERPIGYNPTDDEWDYLK NDIQIMAMALKIQFDQGLTRMTRGSDALGDYQDWVKTTYGKSRFKQWFPVLSLGFDKD LRKAYKGGFTWVNKVFQGKEIGEGIVFDANSHYPAQMYVRPLPYGTPLFYEGEYKENI DYPLYIQNIKVRFRLKERHIPTIQVKQSSLFIQNEYLESSVNKLGVDELIDLTLTNVD LDLFFEHYDILEIHYTYGYMFKASCDMFKGWIDKWIEVKNTTYGARKQNAKLMLNSLY GKFGTNPDITGKVPYMGEDGIVRLTLGEEELRDPVYVPLASFVTAWGRYTTITTAQRC FDNIIYCDTDSIHLTGTEVPEAIEHLVDSKKLGYWEHESTFQRAKFIRQKTYVEEIDG ELNVKCAGMPDRIKELVTFDNFEVGFSSYGKLLPKRTQGGVVLVDTMFTIK |
| H034 | 40 | MIKKYTGDFETTTDLNDCRVWSWGVCDIDNVDNITFGLEIDSFFEWCEMQGSTDIYFH NEKFDGEFMLSWLFKNGFKWCKEAKEERTFSTLISNMGQWYALEICWNVKCTTTKTGK TKKEKQRTIIYDSLKKYPFPVKEIAEAFNFPIKKGEIDITKERPIGYNPTDDEWDYLK NDIQIMAMALKIQFDQGLTRMTRGSDALGDYQDWVKTTYGKSRFKQWFPVLSLGFDKD LRKAYKGGFTWVNKVFQGKEIGEGIVFDVNSLYPSQMYVRPLPYGTPLFYEGEYKENI DYPLYIQNIKVRFRLKERHIPTIQVKQSSLFIQNEYLESSVNKLGVDELIDLTLTNVD LDLFFEHYDILEIHYTYGYMFKASCDMFKGWIDKWIEVKNTTEGARKANAKGMLNSLY GKFGTNPDITGKVPYMGEDGIVRLTLGEEELRDPVYVPLASFVTAWGRYTTITTAQRC FDNIIYCDTDSIHLTGTEVPEAIEHLVDSKKLGYWKHESTFQRAKFIRQKTYVEEIYM KRVKGYLVQGSPDDYTDGELNVKCAGMPDRIKELVTFDNFEVGFSSYGKLLPKRTQGG VVLVDTMFTIK |

TABLE 2-continued

Homologous Polymerase Variants

| Name | SEQ ID NO | Sequence |
|---|---|---|
| H037 | 41 | MGNKKRKIYSCDFETTTDVNDCRVWAYGLMEIDGKFENYKEGNNIDEFMEWTEQEQGD<br>LYFHNLRFDGEFIVNWLLHKGYRFNNTRKAGTFNAVISSMGQWYKIDIYYGREGKKVF<br>KTSIYDSLKKLPFPVKTIAKAFKLPIEKGDIDYDAPRPVGHQITPDESKYIKNDVEII<br>ARALHSQLNTAKLTKMTIGSDALDGFKHSLHKSPKVSKRMYDHHFPVISNAIHEEFKK<br>AYRGGFTWANPKYAGKVIGNGLVFDVNSLYPSVMYDKPLPYGLPVPFSGEYEYDETHP<br>LFIQHIKCGFELKDGHIPTIQIKKNFRFADNEYLHSSEGNILDLHVTNVDLALIKEHY<br>TLYEEEYLQGYKFKQVTGLFKNYIDYWSDKKINAEDPAIRQMAKLMLNSLYGKFGTSI<br>DVTGKEVFLKEDGSTGFRKGQKEERDPVYMPMGAFITAYARDVTIRTAQKCYDRILYC<br>DTDSIHLVGTEIPEAIKDRIHDKKLGYWAHESTFWRAKFIRQKTYIEDLCMRFEGEKV<br>NGEWKFKMVEEKDITKATARELSVKCAGMPAQVKQYVTFDNFGVDFKHDPNDYTDEEI<br>KRKNIKFKLKPTHRKGGQVLVPTPFTIK |
| Q001 | 42 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWEHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q002 | 43 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q003 | 44 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSKGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q004 | 45 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKRVKGKLVQGSPDDYT<br>DIKFSVKCAGMTDKIKKEVTFENFKVGFSRKMKPKPVQVPGGVVLVDETFTIK |
| Q005 | 46 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWCHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q006 | 47 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSYGAIRQLAKLMLNSLYGKFASNPDVTGKVPYL<br>KENGALGFRLGEEETKDPVYTPMGVFITAWGRYTTITAAQACYDRIIYCDTDSIHLTG |

TABLE 2-continued

Homologous Polymerase Variants

| Name | SEQ ID NO | Sequence |
|---|---|---|
| | | TEIPDVIKDIVDPKKLGYWAHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q007 | 48 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSYGAIKRLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q008 | 49 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDARSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q009 | 50 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDDKKLGYWAHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q010 | 51 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q011 | 52 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPDKLGYWAHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q012 | 53 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAFRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q013 | 54 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKGDIDYHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSLYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI |

TABLE 2-continued

Homologous Polymerase Variants

| Name | SEQ ID NO | Sequence |
|---|---|---|
| | | SGLKFKATTGLFKDFIDKWTYIKTTSEGAIKQLAKLMLNSLYGKFASNPDVTGKVPYL<br>KENGALGFRLGEEETKDPVYTPMGVFITAWARYTTITAAQACYDRIIYCDTDSIHLTG<br>TEIPDVIKDIVDPKKLGYWEHESTFKRAKYLRQKTYIQDIYMKEVDGKLVEGSPDDYT<br>DIKFSVKCAGMTDKIKKEVTFENFKVGFSRMKPKPVQVPGGVVLVDDTFTIK |
| Q014 | 55 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKGDIDYHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSLYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSEGAIKQLAKLMLNSLYGKFASNPDVTGKVPYL<br>KENGALGFRLGEEETKDPVYTPMGVFITAWARYTTITAAQACYDRIIYCDTDSIHLTG<br>TEIPDVIKDIVDPKKLGYWCHESTFKRAKYLRQKTYIQDIYMKEVDGKLVEGSPDDYT<br>DIKFSVKCAGMTDKIKKEVTFENFKVGFSRMKPKPVQVPGGVVLVDDTFTIK |
| Q015 | 56 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKGDIDYHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSLYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSEGAIKQLAKLMLNSLYGKFASNPDVTGKVPYL<br>KENGALGFRLGEEETKDPVYTPMGVFITAWARYTTITAAQACYDRIIYCDTDSIHLTG<br>TEIPDVIKDIVDPKKLGYWSHESTFKRAKYLRQKTYIQDIYMKEVDGKLVEGSPDDYT<br>DIKFSVKCAGMTDKIKKEVTFENFKVGFSRMKPKPVQVPGGVVLVDDTFTIK |
| Q016 | 57 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKGDIDYHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSLYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSEGAIKQLAKLMLNSLYGKFASNPDVTGKVPYL<br>KENGALGFRLGEEETKDPVYTPMGVFITAWARYTTITAAQACYDRIIYCDTDSIHLTG<br>TEIPDVIKDIVDPKKLGYWTHESTFKRAKYLRQKTYIQDIYMKEVDGKLVEGSPDDYT<br>DIKFSVKCAGMTDKIKKEVTFENFKVGFSRMKPKPVQVPGGVVLVDDTFTIK |
| Q017 | 58 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKGDIDYHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSLYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSEGAIKQLAKLMLNSLYGKFASNPDVTGKVPYL<br>KENGALGFRLGEEETKDPVYTPMGVFITAWARYTTITAAQACYDRIIYCDTDSIHLTG<br>TEIPDVIKDIVDPKKLGYWNHESTFKRAKYLRQKTYIQDIYMKEVDGKLVEGSPDDYT<br>DIKFSVKCAGMTDKIKKEVTFENFKVGFSRMKPKPVQVPGGVVLVDDTFTIK |
| Q018 | 59 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKGDIDYHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSLYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSEGAIKQLAKLMLNSLYGKFASNPDVTGKVPYL<br>KENGALGFRLGEEETKDPVYTPMGVFITAWARYTTITAAQACYDRIIYCDTDSIHLTG<br>TEIPDVIKDIVDPKKLGYWQHESTFKRAKYLRQKTYIQDIYMKEVDGKLVEGSPDDYT<br>DIKFSVKCAGMTDKIKKEVTFENFKVGFSRMKPKPVQVPGGVVLVDDTFTIK |
| Q019 | 60 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKGDIDYHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSLYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSEGAIKQLAKLMLNSLYGKFASNPDVTGKVPYL<br>KENGALGFRLGEEETKDPVYTPMGVFITAWARYTTITAAQACYDRIIYCDTDSIHLTG<br>TEIPDVIKDIVDPKKLGYWAHESTFKRAKYLRQKTYIQDIYMKEVDGKLVEGSPDDYT<br>DIKFSVKCAGMTDKIKKEVTFENFKVGFSRMKPKPVQVPGGVVLVDDTFTIK |
| Q020 | 61 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW |

TABLE 2-continued

Homologous Polymerase Variants

| Name | SEQ ID NO | Sequence |
|---|---|---|
| | | LNDRFKGKEIGEGMVFDVNSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKRVKGKLVQGSPDDYT<br>DIKFSVKCAGMTDKIKKEVTFENFKVGFSRKMKPKPVQVPGGVVLVDETFTIK |
| Q021 | 62 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWNHASTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q022 | 63 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWQHASTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q023 | 64 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKFGYWAHASTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q024 | 65 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMKSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHSTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q025 | 66 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPSQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHSTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q026 | 67 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKDTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHSTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q027 | 68 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH |

TABLE 2-continued

Homologous Polymerase Variants

| Name | SEQ ID NO | Sequence |
|---|---|---|
| | | TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAWKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHASTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q028 | 69 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQWAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHASTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q029 | 70 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLFLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHASTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q030 | 71 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKAFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHASTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q031 | 72 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTRSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHASTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q032 | 73 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWDYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKKGYWAHASTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q033 | 74 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWEYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKKGYWAHASTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |

TABLE 2-continued

Homologous Polymerase Variants

| Name | SEQ ID NO | Sequence |
|---|---|---|
| Q034 | 75 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSAYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWEHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q035 | 76 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDINSAYPAQMYSRLLPYGEPIVFEGKYVWDEDYPLHIQHIRC<br>EFELKEGYIPTIQIKQSLFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TKIPDVIKDIVHPKKLGYWEHESTFKRAKYLRQKTYIQDIYMKRVRGYLVQGSPDDYT<br>DIKFSVKCAGMTDKIKEEVTFENFKVGFSRKMKPKPVQVPGGVVLVDSVFTIK |
| Q036 | 77 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWEHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| Q037 | 78 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDVNSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSEGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKRVKGKLVQGSPDDYT<br>DIKFSVKCAGMTDKIKKEVTFENFKVGFSRKMKPKPVQVPGGVVLVDETFTIK |
| Q038 | 79 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKRVKGLVEGSPDDYT<br>DIKFSVKCAGMTDKIKKEVTFENFKVGFSRKMKPKPVQVPGGVVLVDETFTIK |
| Q039 | 80 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDVNSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKEVDGKLVQGSPDDYT<br>DIKFSVKCAGMTDKIKKEVTFENFKVGFSRKMKPKPVQVPGGVVLVDETFTIK |
| Q040 | 81 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG |

TABLE 2-continued

Homologous Polymerase Variants

| Name | SEQ ID NO | Sequence |
|---|---|---|
| | | TEIPDVIKDIVDPKKLGYWAHESTFKRAKYLRQKTYIQDIYMKEVDGKLVEGSPDDYT<br>DIKFSVKCAGMTDKIKKEVTFENFKVGFSRKMKPKPVQVPGGVVLVDETFTIK |
| Q041 | 82 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSEGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKEVDGKLVEGSPDDYT<br>DIKFSVKCAGMTDKIKKEVTFENFKVGFSRKMKPKPVQVPGGVVLVDETFTIK |
| Q042 | 83 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSEGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKEVDGKLVEGSPDDYT<br>DIKFSVKCAGMTDKIKKEVTFENFKVGFSRKMKPKPVQVPGGVVLVDDTFTIK |
| Q043 | 84 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTKLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKNSRFYKGNEYLKSSGGEIADLWLSNVDLELMKEHYDLYNVEYI<br>SGLKFKATTGLFKDFIDKWFYIKTTSEGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKHVDGKLVEGSPDDYT<br>KIKFSVKCAGMTDKIKKEVTFENFKVGFSRKMKPKPVQVPGGVVLVDDTFTIK |
| Q044 | 85 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTKLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKNSRFYKGNEYLKSSGGEIADLWLSNVDLELMKEHYDLYNVEYI<br>SGLKFKATTGLFKDFIDKWFYIKTTSEGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKHVGKLVEGSPDDYT<br>KIKFSVKCAGMTDKIKKEVTFENFKVGFSRKMKPKPVQVPGGVVLVDDTFTIK |
| Q045 | 86 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAKDFKLTVLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWFYIKTTSEGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRPKTYIQDIYMKEVDGKLVEGSPDDYT<br>DIKLSVKCAGMTDKIKKEVTFENFKVGFSRKMKPKPVQVPGGVVLVDDTFTIK |
| Q046 | 87 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAKDFKLTKLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKNSRFYKGNEYLKSSGGEIADLWLSNVDLELMKEHYDLYNVEYI<br>SGLKFKATTGLFKDFIDKWFYIKTTSEGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRPKTYIQDIYMKHVDGKLVEGSPDDYT<br>KIKLSVKCAGMTDKIKKEVTFENFKVGFSRKMKPKPVQVPGGVVLVDDTFTIK |
| Q047 | 88 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAKDFKLTKLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKNSRFYKGNEYLKSSGGEIADLWLSNVDLELMKEHYDLYNVEYI |

TABLE 2-continued

Homologous Polymerase Variants

| Name | SEQ ID NO | Sequence |
|---|---|---|
| | | SGLKFKATTGLFKDFIDKWFYIKTTSEGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRPKTYIQDIYMKHVHGKLVEGSPDDYT<br>KIKLSVKCAGMTDKIKKEVTFENFKVGFSRKMKPKPVQVPGGVVLVDDTFTIK |
| Q048 | 89 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAKDFKLTKLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKNSRFYKGNEYLKSSGGEIADLWLSNVDLELMKEHYDLYNVEYI<br>SGLKFKATTGLFKDFIDKWFYIKTTSEGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRPKTYIQDIYMKNVNGKLVEGSPDDYT<br>KIKLSVKCAGMTDKIKKEVTFENFKVGFSRKMKPKPVQVPGGVVLVDDTFTIK |
| Q049 | 90 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTKLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKNSRFYKGNEYLKSSGGEIADLWLSNVDLELMKEHYDLYNVEYI<br>SGLKFKATTGLFKDFIDKWFYIKTTSEGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRPKTYIQDIYMKHVHGKLVEGSPDDYT<br>KIKLSVKCAGMTDKIKKEVTFENFKVGFSRKMKPKPVQVPGGVVLVDDTFTIK |
| Q050 | 91 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTKLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKNSRFYKGNEYLKSSGGEIADLWLSNVDLELMKEHYDLYNVEYI<br>SGLKFKATTGLFKDFIDKWFYIKTTSEGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRPKTYIQDIYMKNVNGKLVEGSPDDYT<br>KIKLSVKCAGMTDKIKKEVTFENFKVGFSRKMKPKPVQVPGGVVLVDDTFTIK |
| Q051 | 92 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAKDFKLTKLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKNSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRPKTYIQDIYMKHVDGKLVEGSPDDYT<br>KIKLSVKCAGMTDKIKKEVTFENFKVGFSRKMKPKPVQVPGGVVLVDDTFTIK |
| Q052 | 93 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAKDFKLTKLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKNSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRPKTYIQDIYMKHVHGKLVEGSPDDYT<br>KIKLSVKCAGMTDKIKKEVTFENFKVGFSRKMKPKPVQVPGGVVLVDDTFTIK |
| Q053 | 94 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTKLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKNSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKHVDGKLVEGSPDDYT<br>KIKFSVKCAGMTDKIKKEVTFENFKVGFSRKMKPKPVQVPGGVVLVDDTFTIK |
| Q054 | 95 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAKDFKLTKLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW |

TABLE 2-continued

Homologous Polymerase Variants

| Name | SEQ ID NO | Sequence |
|---|---|---|
| | | LNDRFKEKEIGEGMVFDVNSHYPAQMYSRLLPYGEPIVFEGKYVWDEDYPLHIQHIRC<br>EFELKEGYIPTIQIKNSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRPKTYIQDIYMKHVHGKLVNGSPDDYT<br>KIKLSVKCAGMTDKIKKEVTFENFKVGFSRKMKPKPVQVPGGVVLVDDTFTIK |
| Q055 | 96 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAKDFKLTKLKGDIDIHKERPVGYKITPEEYAYIKNDIQIIA<br>EALLIQFKQGLDRMTAGSDSLKGFKDIITTKKFKKVFPTLSLGLDKEVRYAYRGGFTW<br>LNDRFKEKEIGEGMVFDVNSHYPAQMYSRLLPYGEPIVFEGKYVWDEDYPLHIQHIRC<br>EFELKEGYIPTIQIKNSRFYKGNEYLKSSGGEIADLWLSNVDLELMKEHYDLYNVEYI<br>SGLKFKATTGLFKDFIDKWFYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRPKTYIQDIYMKHVDGKLVNGSPDDYT<br>KIKLSVKCAGMTDKIKKEVTFENFKVGFSRKMKPKPVQVPGGVVLVDDTFTIK |

In some embodiments, amino acids are selected for modification based on structure and/or function of a polymerase. For example, FIG. 2 depicts a cartoon illustration of Φ29 polymerase 200. The folded, three-dimensional structure comprises distinct domains and subdomains corresponding to overlay 202: an N-terminal exonuclease domain (1) and a C-terminal polymerase domain that contains a palm subdomain (2), a terminal protein region 1 subdomain (TPR1) (3), a fingers subdomain (4), a TPR2 subdomain (5), and a thumb subdomain (6). These domains and subdomains map to areas of the polypeptide strand according to polypeptide construct 204, which is oriented in an N-terminal to C-terminal fashion. As shown, the N-terminal exonuclease domain (1) spans residues 1-189 and the C-terminal polymerase domain spans residues 190-575 of wild-type Φ29 polymerase. Within the C-terminal polymerase domain, the palm subdomain (2) spans residues 190-260 and 427-530, the TPR1 subdomain (3) spans residues 261-358, the fingers subdomain (4) spans residues 359-394, the TPR2 subdomain (5) spans residues 395-426, and the thumb subdomain (6) spans residues 531-575 of wild-type Φ29 polymerase. Equivalent segments (e.g., domains or portions thereof, optionally including flanking amino acids) of different polymerases described in this application can be substituted for each other to produce chimeric polymerases. For example, one or more of an exonuclease domain, a palm subdomain, a TPR1 subdomain, one or more finger subdomains, a TPR2 subdomain, and/or a thumb subdomain from one polymerase (e.g., having a wild type sequence shown in Table 1 or having one or more mutations exemplified in Table 2 or described in Tables 3-5) can be substituted for a corresponding domain in another polymerase (e.g., having a wild type sequence shown in Table 1 or having one or more mutations exemplified in Table 2 or described in Tables 3-5). In some embodiments, segments comprising portions of one or more of these domains, optionally including one or more flanking amino acids, can be substituted.

In some embodiments, a modified polymerase comprises a majority polymerase sequence other than Φ29 polymerase. In such embodiments, the majority polymerase sequence comprises one or more regions that may be analogized to Φ29 polymerase 200 (e.g., based on homology alignment, computational modeling, structural analysis, or any suitable method). As used herein, a "region" of a polymerase refers to a distinct domain or subdomain of a polymerase enzyme. For example, in some embodiments, a region of a polymerase refers to an N-terminal exonuclease domain or a C-terminal polymerase domain. In some embodiments, a region of a polymerase refers to a palm subdomain, a TPR1 subdomain, a fingers subdomain, a TPR2 subdomain, or a thumb subdomain. Accordingly, in some embodiments, a region of a polymerase refers to all amino acids that comprise a given domain or subdomain. In some embodiments, a modified polymerase comprises modifications to one or more regions of a majority polymerase sequence. In some embodiments, a modified polymerase comprises modifications to one or more portions of a majority polymerase sequence. As used herein, a "portion" of a polymerase refers to a stretch of two or more consecutive residues within the polymerase sequence. In some embodiments, a portion of a polymerase sequence refers to two or more consecutive amino acids in a single polymerase domain or a single polymerase subdomain. In some embodiments, a portion of a polymerase sequence refers to two or more consecutive amino acids spanning more than one polymerase domain and/or subdomain. Thus, in some embodiments, a portion of a polymerase sequence is any stretch of consecutive amino acids within the polymerase sequence. In some embodiments, a portion refers to 5-10 consecutive amino acids, 10-25 consecutive amino acids, 25-50 consecutive amino acids, 50-75 consecutive amino acids, 75-100 consecutive amino acids or other number of consecutive amino acids that constitute a portion of, for example, a polymerase region or domain.

In some embodiments, a modified polymerase comprises one or more single-site mutations in one or more of the domains and/or subdomains as generally depicted in FIG. 2. For example, FIG. 3 depicts selected mutational variants of Table 2 with sites of mutation (shown approximated with arrows) within each polypeptide strand. Polypeptide strands are shown for M2Y and M2Y mutational variant H016 (open fill), *Lucilia cuprina* and *Lucilia cuprina* mutational variant H018 (stippled fill), *Enterococcus faecium* and *Enterococcus faecium* mutational variant H020 (dashed line fill), and *Bacillus* phage VMY22 and *Bacillus* phage VMY22 mutational variant H022 (diagonal line fill). However, chimeras comprising other segment swaps and/or amino acid mutations as described herein also can be used.

In some embodiments, in addition or alternative to the one or more single-site mutational modifications described herein, a stretch of amino acids (e.g., two or more consecutive amino acids) in a majority polymerase sequence are modified. In some embodiments, the stretch of amino acids is a stretch of amino acids corresponding to a portion of a different polymerase sequence. For example, in some embodiments, a domain/subdomain (or a portion therein) of a majority polymerase sequence is swapped with a corresponding domain/subdomain (or portion therein) of a different polymerase sequence. In such embodiments, the polymerase is referred to as a chimeric polymerase, chimeric polymerase variant, or a chimera. Chimeric polymerases were engineered in accordance with embodiments described herein and are listed in Table 3 (SEQ ID NOs: 97-516).

TABLE 3

Chimeric Polymerase Variants

| Name | SEQ ID NO | Sequence |
|---|---|---|
| C001 | 97 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRLLPYGEPIVFEGKYVWDEQYPLYIQRIRFEFE<br>LKEGYIPTIQIKKNPFFKGNEYLKNSGVEPVELYLTNVDLELIQEHYELYNVEYIDGF<br>KFRETTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C002 | 98 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRLLPYGEPIVFEGKYVWDEDYPLHIQHIRCEFE<br>LKEGYIPTIQIKKNPFFKGNEYLKNSGVEPVELYLTNVDLELIQEHYELYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C003 | 99 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRLLPYGEPIVFEGKYVWDEDYPLHIQHIRCEFE<br>LKEGYIPTIQIKKNPFFKGNEYLKNSGVEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C004 | 100 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRILPYGDPIVFDGKYVWDDEYPLHIQHIRCEFE<br>LKDGYIPTIQIKRSRFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C005 | 101 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRILPYGDPIVFDGKYVWDDEYPLHIQHIRCDFE<br>LKDGYIPTIQIKRSRFYKGNEYLKSSGGDLVELWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C006 | 102 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRILPYGDPIVFDGKYVWDDEYPLHIQHIRCDFE<br>LKDGYIPTIQIKRSRFYKGNEYLKSSGGDLVELWISQVDIDLMKEHYELYNVEYLSGI<br>KFRATTGIFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C007 | 103 | MSRKMFSCDFETTTRLDDCRVWAYGYMEIGNLDNYKLGNSLDEFMQWVMEINADLYFH<br>DLKFDGAFLVNWLEQHGFRWSNEGLPNTYNTIISKMGQWYMIDICFGYKGKRKLHTVI |

TABLE 3-continued

Chimeric Polymerase Variants

| Name | SEQ ID NO | Sequence |
|---|---|---|
| | | YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRLLPYGEPIVFEGKYVWDEDYPLHIQHIRCEFE<br>LKEGYIPTIQIKRSRFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C008 | 104 | MSRKMFSCDFETTTRLDDCRVWAYGYMEIGNLDNYKLGNSLDEFMQWVMEINADLYFH<br>DLKFDGAFLVNWLEQHGFRWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRILPYGDPIVFDGKYVWDDEYPLHIQHIRCDFE<br>LKDGYIPTIQIKRSRFYKGNEYLKSSGGDLVELWISQVDIDLMKEHYELYNVEYLSGI<br>KFRATTGIFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C009 | 105 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRILPYGDPIVFDGKYVWDDEYPLHIQHIRCDFE<br>LKDGYIPTIQIKRSRFYKGNEYLKSSGGELVELYVTNIDLDLIKEHYELYNVEYLSGL<br>KFRATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C010 | 106 | MIKKYTGDFETTTDLNDCRVWSWGVCDIDNVDNITFGLEIDSFFEWCEMQGSTDIYFH<br>NEKFDGEFMLSWLFKNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYSRLLPYGEPIVFEGKYVWDEDYPLHIQHIRCEFE<br>LKEGYIPTIQIKRSRFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C011 | 107 | MIKKYTGDFETTTDLNDCRVWSWGVCDIDNVDNITFGLEIDSFFEWCEMQGSTDIYFH<br>NEKFDGEFMLSWLFKNGFKWCKEAKEERTFSTLISNMGQWYALEICWNVKCTTTKTGK<br>TKKEKQRTIIYDSLKKYYPFPVKEIAEAFNFPIKKGEIDYTKERPIGYNPTDDEWDYK<br>NDIQIMAMALKIQFDQGLDRMTAGSDSLKGFKDIITTKKFKKVFPTLSLGLDKEVRKA<br>YRGGFTWLNDRFKGKEIGEGMVFDANSHYPAQMYSRLLPYGEPIVFEGKYVWDEDYPL<br>HIQHIRCEFELKEGYIPTIQIKRSRFYKGNEYLKSSGGEIADLWLSNVDLELMKEHYD<br>LYNVEYISGLKFKATTGLFKDFIDKWTYIKTTSYGAIKQLAKLMLNSLYGKFASNPDV<br>TGKVPYLKENGALGFRLGEEETKDPVYTPMGVFITAWGRYTTITAAQACYDRIIYCDT<br>DSIHLTGTEIPDVIKDIVDPKKLGYWEHESTFKRAKYLRQKTYIQDIYMKRVKGYLVQ<br>GSPDDYTDIKFSVKCAGMTDKIKKEVTFENFKVGFSRKMKPKPVQVPGGVVLVDETFT<br>IK |
| C012 | 108 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPTIQIKRSRFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWEHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| C013 | 109 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMPKASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |

TABLE 3-continued

Chimeric Polymerase Variants

| Name | SEQ ID NO | Sequence |
|------|-----------|----------|
| C014 | 110 | MIKKYTGDFETTTDLNDCRVWSWGVCDIDNVDNITFGLEIDSFFEWCEMQGSTDIYFH<br>NEKFDGEFMLSWLFKNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQIKRSRFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C015 | 111 | MIKKYTGDFETTTDLNDCRVWSWGVCDIDNVDNITFGLEIDSFFEWCEMQGSTDIYFH<br>NEKFDGEFMLSWLFKNGFKWCKEAKEERTFSTLISNMGQWYALEICWNVKCTTTKTGK<br>TKKEKQRTIIYDSLKKYPFPVKEIAEAFNPIKKGEIDYTKERPIGYNPTDDEWDYLK<br>NDIQIMAMALKIQFDQGLDRMTAGSDSLKGFKDIITTKKFKKVFPTLSLGLDKEVRKA<br>YRGGFTWLNDRFKGKEIGEGMVFDANSHYPAQMYVRPLPYGTPLFYEGEYKENIDYPL<br>YIQNIKVRFRLKERHIPTIQVKQSSLFIQNEYLESSVNKLGVDELIDLTLTNVDLDLF<br>FEHYDILEIHYTYGYMFKASCDMFKDFIDKWTYIKTTSYGAIKQLAKLMLNSLYGKFA<br>SNPDVTGKVPYLKENGALGFRLGEEETKDPVYTPMGVFITAWGRYTTITAAQACYDRI<br>IYCDTDSIHLTGTEIPDVIKDIVDPKKLGYWEHESTFKRAKYLRQKTYIQDIYMKRVK<br>GYLVQGSPDDYTDIKFSVKCAGMTDKIKKEVTFENFKVGFSRKMKPKPVQVPGGVVLV<br>DETFTIK |
| C016 | 112 | MSRKMFSCDFETTTKLDDCRVWAYGYMEIGNLDNYKIGNSLDEFMQWVMEIQADLYFH<br>NLKFDGAFIVNWLEQHGFKWSNEGLPNTYNTIISKMGQWYMIDICFGYKGKRKLHTVI<br>YDSLKKLPFPVVKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRLLPYGEPIVFEGKYVWDEDYPLHIQHIRCEFE<br>LKEGYIPTIQIKRSRFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWAHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C017 | 113 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVVKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRLLPYGEPIVFEGKYVWDEDYPLHIQHIRCEFE<br>LKEGYIPTIQIKRSRFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C018 | 114 | MKHMPRKMYSCDFETTTKVEDCRVWAYGYMNIEDHSEYKIGNSLDEFMAWVLKVQADL<br>YFHDLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRPLPYGAPIVFQGKYEKDEQYPLYIQRIRF<br>EFELKEGYIPTIQIKKNPFFKGNEYLKNSGVEPVELYLTNVDLELIQEHYELYNVEYI<br>DGFKFREKTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWEHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| C019 | 115 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVVKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRPLPYGAPIVFQGKYEKDEQYPLYIQRIRFEFE<br>LKEGYIPTIQIKKNPFFKGNEYLKNSGVEPVELYLTNVDLELIQEHYELYNVEYIDGF<br>KFREKTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C020 | 116 | MKHMPRKMYSCDFETTTDVNDCRVWAYGWMEIGKTSNYKIGTDFNEFMEWMIHSSSRL<br>YFHDLKFDGSFIVNWLLHNGYTWTKRPSKEGQFSTLISKMGQWYGITICSGRDGRKKK<br>LTTIHDSLKKLPFPVRKIGKDFKLNVLKGDIDYHKPRPIGYEIDDEEYQIIKNDIQII<br>AEALEVQTVQGLTGMTNGSDSLKGFKDIITTKKFKKVFPTLSLGLDKEVRKAYRGGFT<br>WLNDRFKGKEIGEGMVFDANSHYPAQMYSRLLPYGEPIVFEGKYVWDEDYPLHIQHIR<br>CEFELKEGYIPTIQIKRSRFYKGNEYLKSSGGEIADLWLSNVDLELMKEHYDLYNVEY<br>ISGLKFKATTGLFKDFIDKWTYIKTTSYGAIKQLAKLMLNSLYGKFASNPDVTGKVPY<br>LKENGALGFRLGEEETKDPVYTPMGVFITAWGRYTTITAAQACYDRIIYCDTDSIHLT |

TABLE 3-continued

Chimeric Polymerase Variants

| Name | SEQ ID NO | Sequence |
|---|---|---|
| | | GTEIPDVIKDIVDPKKLGYWEHESTFKRAKYLRQKTYIQDIYMKRVKGYLVQGSPDDY<br>TDIKFSVKCAGMTDKIKKEVTFENFKVGFSRKMKPKPVQVPGGVVLVDETFTIK |
| C021 | 117 | MKHMPRKMYSCDFETTTKVEDCRVWAYGYMNIEDHSEYKIGNSLDEFMAWVLKVQADL<br>YFHDLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYDRDLPCGVPIPFEGEYVYDKSHPLYIQKLTF<br>EFELKENYIPTIQLKNSRFGFKGNEYLSSSNGERITISVSSVDWELIREHYHVYDVEF<br>EKGWKFRSTKQAFKDFIDKWTYIKTTSYGAIKQLAKLMLNSLYGKFASNPDVTGKVPY<br>LKENGALGFRLGEEETKDPVYTPMGVFITAWGRYTTITAAQACYDRIIYCDTDSIHLT<br>GTEIPDVIKDIVDPKKLGYWEHESTFKRAKYLRQKTYIQDIYMKRVKGYLVQGSPDDY<br>TDIKFSVKCAGMTDKIKKEVTFENFKVGFSRKMKPKPVQVPGGVVLVDETFTIK |
| C022 | 118 | MKHMPRKMYSCDFETTTDVNDCRVWAYGWMEIGKTSNYKIGTDFNEFMEWMIHSSSRL<br>YFHDLKFDGSFIVNWLLHNGYTWTKRPSKEGQFSTLISKMGQWYGITICSGRDGRKKK<br>LTTIHDSLKKLPFPVRKIGKDFKLNVLKGDIDYHKPRPIGYEIDDEEYQYIKNDIQII<br>AEALEVQTVQGLTGMTNGSDSLKGFKDIITTKKFKKVFPTLSLGLDKEVRKAYRGGFT<br>WLNDRFKGKEIGEGMVFDANSHYPAQMYDRDLPCGVPIPFEGEYVYDKSHPLYIQKLT<br>FEFELKENYIPTIQLKNSRFGFKGNEYLSSSNGERITISVSSVDWELIREHYHVYDVE<br>FEKGWKFRSTKQAFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C023 | 119 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAFRGGFTW<br>LNDRFKGKEIGEGMVFDANSHYPAQMYSRLLPYGEPIVFEGKYVWDEDYPLHIQHIRC<br>EFELKEGYIPTIQIKRSRFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWAHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| C024 | 120 | MIKKYTGDFETTTDLNDCRVWSWGVCDIDNVDNITFGLEIDSFFEWCEMQGSTDIYFH<br>NEKFDGEFMLSWLFKNGFKWCKEAKEERTFSTLISNMGQWYALEICWNVKCTTTKTGK<br>TKKEKQRTIIYDSLKKYPFPVKEIAEAFNFPIKKGEIDYTKERPIGYNPTDDEWDYLK<br>NDIQIMAMALKIQFDQGLTRMTRGSDALGDFKDIITTKKFKKVFPTLSLGLDKEVRKA<br>YRGGFTWLNDRFKGKEIGEGMVFDANSHYPAQMYSRLLPYGEPIVFEGKYVWDEDYPL<br>HIQHIRCEFELKEGYIPTIQIKRSRFYKGNEYLKSSGGEIADLWLSNVDLELMKEHYD<br>LYNVEYISGLKFKATTGLFKDFIDKWTYIKTTSYGAIKQLAKLMLNSLYGKFASNPDV<br>TGKVPYLKENGALGFRLGEEETKDPVYTPMGVFITAWGRYTTITAAQACYDRIIYCDT<br>DSIHLTGTEIPDVIKDIVDPKKLGYWEHESTFKRAKYLRQKTYIQDIYMKRVKGYLVQ<br>GSPDDYTDIKFSVKCAGMTDKIKKEVTFENFKVGFSRKMKPKPVQVPGGVVLVDETFT<br>IK |
| C025 | 121 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRLLPYGEPIVFEGKYVWDEDYPLHIQHIRCEFE<br>LKEGYIPTIQIKRSRFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEV<br>PEAIEHLVDSKKLGYWEHESTFQRAKFIRQKTYIQDIYMKRVKGYLVQGSPDDYTDIK<br>FSVKCAGMTDKIKKEVTFENFKVGFSRKMKPKPVQVPGGVVLVDETFTIK |
| C026 | 122 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRLLPYGEPIVFEGKYVWDEDYPLHIQHIRCEFE<br>LKEGYIPTIQIKRSRFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEV<br>PEAIEHLVDPKKLGYWEHESTFQRAKFIRQKTYIQDIYMKRVKGYLVQGSPDDYTDIK<br>FSVKCAGMTDKIKKEVTFENFKVGFSRKMKPKPVQVPGGVVLVDETFTIK |
| C027 | 123 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRLLPYGEPIVFEGKYVWDEDYPLHIQHIRCEFE |

TABLE 3-continued

Chimeric Polymerase Variants

| Name | SEQ ID NO | Sequence |
|---|---|---|
| | | LKEGYIPTIQIKRSRFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYVKKVRGYLVQCSPDEATTTK<br>FSVKCAGMTDKIKKEVTFENFKVGFSRKMKPKPVQVPGGVVLVDETFTIK |
| C028 | 124 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRLLPYGEPIVFEGKYVWDEDYPLHIQHIRCEFE<br>LKEGYIPTIQIKRSRFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEV<br>PEAIEHLVDPKKLGYWEHESTFQRAKFIRQKTYIQDIYVKKVRGYLVQCSPDEATTTK<br>FSVKCAGMTDKIKKEVTFENFKVGFSRKMKPKPVQVPGGVVLVDETFTIK |
| C029 | 125 | MIKKYTGDFETTTDLNDCRVWSWGVCDIDNVDNITFGLEIDSFFEWCEMQGSTDLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYSRLLPYGEPIVFEGKYVWDEDYPLHIQHIRCEFE<br>LKEGYIPTIQIKRSRFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C030 | 126 | MIKKYTGDFETTTDLNDCRVWSWGVCDIDNVDNITFGLEIDSFFEWCEMQGSTDIYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C031 | 127 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C032 | 128 | MVRQSTIASPARGGVRRSHKKVPSFCADFETTTDEDDCRVWSWGIIQVGKLQNYVDGI<br>SLDGFMSHISERASHIYFHDLKFDGAFIINWLERNGFKWSADGLPNTYNTIISRMGQW<br>YMIDICLGYKGKRKIHTVIYDSLKKLPFPVEKIAKDFKLTVKKGDIDIHKERPVGYKI<br>TPEEYAYIKNDIQIIAEALLIQFKQGLDRMTAGSDSLKGFKDIITTKKFKKVFPTLSL<br>GLDKEVRKAYRGGFTWLNDRFKGKEIGEGMVFDANSHYPAQMYVRPLPYGTPLFYEGE<br>YKENIDYPLYIQNIKVRFRLKERHIPTIQVKQSSLFIQNEYLESSVNKLGVDELIDLT<br>LTNVDLDLFFEHYDILEIHYTYGYMFKASCDMFKDFIDKWTYIKTTSYGAIKQLAKLM<br>LNSLYGKFASNPDVTGKVPYLKENGALGFRLGEEETKDPVYTPMGVFITAWGRYTTIT<br>AAQACYDRIIYCDTDSIHLTGTEIPDVIKDIVDPKKLGYWEHESTFKRAKYLRQKTYI<br>QDIYMKRVKGYLVQGSPDDYTDIKFSVKCAGMTDKIKKEVTFENFKVGFSRKMKPKPV<br>QVPGGVVLVDETFTIK |
| C033 | 129 | MNEYISDFETQKDPDTGVMSVWAWSIVDVNDLSNIQYGNNIESWLSAIQGLPNGSLIG<br>FHDLKFDGAFIINWLERNGFKWSADGLPNTYNTIISRMGQWYMIDICLGYKGKRKIHT<br>VIYDSLKKLPFPVEKIAKDFKLTVKKGDIDIHKERPVGYKITPEEYAYIKNDIQIIAE<br>ALLIQFKQGLDRMTAGSDSLKGFKDIITTKKFKKVFPTLSLGLDKEVRKAYRGGFTWL<br>NDRFKGKEIGEGMVFDANSHYPAQMYVRPLPYGTPLFYEGEYKENIDYPLYIQNIKVR<br>FRLKERHIPTIQVKQSSLFIQNEYLESSVNKLGVDELIDLTLTNVDLDLFFEHYDILE<br>IHYTYGYMFKASCDMFKDFIDKWTYIKTTSYGAIKQLAKLMLNSLYGKFASNPDVTGK<br>VPYLKENGALGFRLGEEETKDPVYTPMGVFITAWGRYTTITAAQACYDRIIYCDTDSI<br>HLTGTEIPDVIKDIVDPKKLGYWEHESTFKRAKYLRQKTYIQDIYMKRVKGYLVQGSP<br>DDYTDIKFSVKCAGMTDKIKKEVTFENFKVGFSRKMKPKPVQVPGGVVLVDETFTIK |
| C034 | 130 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI |

TABLE 3-continued

Chimeric Polymerase Variants

| Name | SEQ ID NO | Sequence |
|---|---|---|
| | | YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C035 | 131 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKGWIDKWIEVKNTTEGARKANAKGMLNSLYGKFGTNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMPDRIKELVTFDNFEVGFSSYGKLLPKRTQGGVVLVDTMFTIK |
| C036 | 132 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTTSYGAIKQLAKLMLNSLYGKFGTNPDITG<br>KVPYMGEDIVRLTLGEEEELRDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMPDRIKELVTFDNFEVGFSSYGKLLPKRTQGGVVLVDTMFTIK |
| C037 | 133 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPYGEPIYSEGAPRTNRPLYIASITFTA<br>KLKPNHIPCIQIKKNLSFNPTQYLEEVKEPTTVVATNIDIELWKKHYDFKIYSWNGTF<br>EFRGSHGFFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTEI<br>PDVIKDIVDPKKLGYWEHESTFKRAKYLRQKTYIQDIYMKRVKGYLVQGSPDDYTDIK<br>FSVKCAGMTDKIKKEVTFENFKVGFSRKMKPKPVQVPGGVVLVDETFTIK |
| C038 | 134 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYSRLLPIGTPVFFEGKYKDDPIYPLYIQFITA<br>QFELKKGKIPTIQIKNDKRFNPREYVSTGCLMVNLYLTNVDLEMFYECYNIKEIQYI<br>GGYKFIGRSGIFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TEIPDVIKDIVDPKKLGYWEHESTFKRAKYLRQKTYIQDIYMKRVKGYLVQGSPDDYT<br>DIKFSVKCAGMTDKIKKEVTFENFKVGFSRKMKPKPVQVPGGVVLVDETFTIK |
| C039 | 135 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C040 | 136 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISRMGQWYMIDICLGYKGKRKIHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |

TABLE 3-continued

Chimeric Polymerase Variants

| Name | SEQ ID NO | Sequence |
|---|---|---|
| C041 | 137 | MSRKMFSCDFETTTKLDDCRVWAYGYMEIGNLDNYKIGNSLDEFMQWVMEIQADLYFH<br>DLKFDGAFIVNWLERNGFKWSNEGLPNTYNTIISKMGQWYMIDICIGYKGKRKLHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C042 | 138 | MSRKMFSCDFETTTKLDDCRVWAYGYMEIGNLDNYKIGNSLDEFMQWVMEIQADLYFH<br>DLKFDGAFIVNWLERNGFKWSNEGLPNTYNTIISKMGQWYMIDICIGYKGKRKLHTVI<br>YDSLKKLPFPVEKIAKDFQLTLKKGDIDIHKERPVGYEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C043 | 139 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYVKEVDGKLKECSPDE<br>ATDIKFSVKCAGMTDKIKKEVTFENFKVGFSRKMKPKPVQVPGGVVLVDETFTIK |
| C044 | 140 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYVKRVDGYLVECSPDE<br>YTDIKFSVKCAGMTDKIKKEVTFENFKVGFSRKMKPKPVQVPGGVVLVDETFTIK |
| C045 | 141 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYVPLASFVTAWGRYTTITTAQRCFDNIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C046 | 142 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C047 | 143 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYVPLASFVTAWGRYTTITTAQRCFDNIIYCDTDSIHL |

TABLE 3-continued

Chimeric Polymerase Variants

| Name | SEQ ID NO | Sequence |
|---|---|---|
| | | TGTEIPDVIKDIVDPKKLGYWEHESTFKRAKYLRQKTYIQDIYVKEVDGKLKECSPDE<br>ATDIKFSVKCAGMTDKIKKEVTFENFKVGFSRKMKPKPVQVPGGVVLVDETFTIK |
| C048 | 144 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTEIPDVIKDIVDPKKLGYWEHESTFKRAKYLRQKTYIQDIYVKEVDGKLKECSPDE<br>ATDIKFSVKCAGMTDKIKKEVTFENFKVGFSRKMKPKPVQVPGGVVLVDETFTIK |
| C049 | 145 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYVPLASFVTAWGRYTTITTAQRCFDNIIYCDTDSIHL<br>TGTEIPDVIKDIVDPKKLGYWEHESTFKRAKYLRQKTYIQDIYVKRVDGYLVECSPDE<br>YTDIKFSVKCAGMTDKIKKEVTFENFKVGFSRKMKPKPVQVPGGVVLVDETFTIK |
| C050 | 146 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTEIPDVIKDIVDPKKLGYWEHESTFKRAKYLRQKTYIQDIYVKRVDGYLVECSPDE<br>YTDIKFSVKCAGMTDKIKKEVTFENFKVGFSRKMKPKPVQVPGGVVLVDETFTIK |
| C051 | 147 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITTAAQACYDRIIYCDTDSIHL<br>TGTEIPDVIKDIVDPKKLGYWEHESTFKRAKYLRQKTYIQDIYVKEVDGKLKECSPDE<br>ATDIKFSVKCAGMTDKIKKEVTFENFKVGFSRKMKPKPVQVPGGVVLVDETFTIK |
| C052 | 148 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITTAAQACYDRIIYCDTDSIHL<br>TGTEIPDVIKDIVDPKKLGYWEHESTFKRAKYLRQKTYIQDIYVKRVDGYLVECSPDE<br>YTDIKFSVKCAGMTDKIKKEVTFENFKVGFSRKMKPKPVQVPGGVVLVDETFTIK |
| C053 | 149 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYVPLASFVTAWGRYTTITTAQRCFDNIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C054 | 150 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH |

TABLE 3-continued

Chimeric Polymerase Variants

| Name | SEQ ID NO | Sequence |
|---|---|---|
| | | YTYGYMFKASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C055 | 151 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYVPLASFVTAWGRYTTITTAQRCFDNIIYCDTDSIHL<br>TGTEIPDVIKDIVDPKKLGYWEHESTFKRAKYLRQKTYIQDIYVKEVDGKLKECSPDE<br>ATDIKFSVKCAGMTDKIKKEVTFENFKVGFSRKMKPKPVQVPGGVVLVDETFTIK |
| C056 | 152 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTEIPDVIKDIVDPKKLGYWEHESTFKRAKYLRQKTYIQDIYVKEVDGKLKECSPDE<br>ATDIKFSVKCAGMTDKIKKEVTFENFKVGFSRKMKPKPVQVPGGVVLVDETFTIK |
| C057 | 153 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYVPLASFVTAWGRYTTITTAQRCFDNIIYCDTDSIHL<br>TGTEIPDVIKDIVDPKKLGYWEHESTFKRAKYLRQKTYIQDIYVKRVDGYLVECSPDE<br>YTDIKFSVKCAGMTDKIKKEVTFENFKVGFSRKMKPKPVQVPGGVVLVDETFTIK |
| C058 | 154 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTEIPDVIKDIVDPKKLGYWEHESTFKRAKYLRQKTYIQDIYVKRVDGYLVECSPDE<br>YTDIKFSVKCAGMTDKIKKEVTFENFKVGFSRKMKPKPVQVPGGVVLVDETFTIK |
| C059 | 155 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFGTNPDITGKVP<br>YMGEDGIVRLTLGEEETKDPVYVPLASFVTAWGRYTTITTAQRCFDNIIYCDTDSIHL<br>TGTEIPDVIKDIVDPKKLGYWEHESTFKRAKYLRQKTYIQDIYVKRVDGYLVECSPDE<br>YTDIKFSVKCAGMPDRIKELVTFDNFEVGFSSYGKLLPKRTQGGVVLVDTMFTIK |
| C060 | 156 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFGTNPDITGKVP<br>YMGEDGIVRLTLGEEETKDPVYVPLASFVTAWGRYTTITTAQRCFDNIIYCDTDSIHL<br>TGTEIPDVIKDIVDPKKLGYWEHESTFKRAKYLRQKTYIQDIYVKRVDGYLVECSPDE<br>YTDIKFSVKCAGMTDKIKKEVTFENFKVGFSRKMKPKPVQVPGGVVLVDETFTIK |
| C061 | 157 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND |

TABLE 3-continued

Chimeric Polymerase Variants

| Name | SEQ ID NO | Sequence |
|---|---|---|
| | | RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYVPLASFVTAWGRYTTITTAQRCFDNIIYCDTDSIHL<br>TGTEIPDVIKDIVDPKKLGYWEHESTFKRAKYLRQKTYIQDIYVKRVDGYLVECSPDE<br>YTDIKFSVKCAGMPDRIKELVTFDNFEVGFSSYGKLLPKRTQGGVVLVDTMFTIK |
| C062 | 158 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFGTNPDITGKVP<br>YMGEDGIVRLTLGEEETKDPVYVPLASFVTAWGRYTTITTAQRCFDNIIYCDTDSIHL<br>TGTEIPDVIKDIVDPKKLGYWEHESTFKRAKYLRQKTYIQDIYVKEVDGKLKECSPDE<br>ATDIKFSVKCAGMPDRIKELVTFDNFEVGFSSYGKLLPKRTQGGVVLVDTMFTIK |
| C063 | 159 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFGTNPDITGKVP<br>YMGEDGIVRLTLGEEETKDPVYVPLASFVTAWGRYTTITTAQRCFDNIIYCDTDSIHL<br>TGTEIPDVIKDIVDPKKLGYWEHESTFKRAKYLRQKTYIQDIYVKEVDGKLKECSPDE<br>ATDIKFSVKCAGMTDKIKKEVTFENFKVGFSRKMKPKPVQVPGGVVLVDETFTIK |
| C064 | 160 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYVPLASFVTAWGRYTTITTAQRCFDNIIYCDTDSIHL<br>TGTEIPDVIKDIVDPKKLGYWEHESTFKRAKYLRQKTYIQDIYVKEVDGKLKECSPDE<br>ATDIKFSVKCAGMPDRIKELVTFDNFEVGFSSYGKLLPKRTQGGVVLVDTMFTIK |
| C065 | 161 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYQGEYKENIDHPLYIQNLKV<br>RFRLKERHIPTIQVKQNSLFIQNEYLENSVNKLGVDELIDLTLTNVDLDLFFEHYEIL<br>EIHFTYGYMFRASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C066 | 162 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPCIQVKQSSLFIQTEYLESSVNKLGVDELIELTLTNVDLDLFFEHYEIL<br>EIHFTYGYMFRGSCDMFKDFIDKFTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C067 | 163 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYQGEYKENIQYPLYIQNIKV<br>RFRLKERHIPTIQVKQNSLFIQNEYLENSVNKLGVDELIELTLTNVDLDLFFEHYEIL<br>EIHYTYGYMFRGSCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C068 | 164 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH |

TABLE 3-continued

Chimeric Polymerase Variants

| Name | SEQ ID NO | Sequence |
|---|---|---|
| | | TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDHPLYIQNLKV<br>RFRLKERHIPCIQVKQSSLFIQTEYLESSVNKLGVDELIELTLTNVDLDLFFEHYEIL<br>EIHYTTYGYMFRGSCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C069 | 165 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYQGEYKENIQYPLYIQNIKV<br>RFRLKERHIPTIQVKQNSLFIQTEYLENSVNKLGVDELIDLTVTNVDLDLFFEHYDIL<br>EIHFTYGYMFKASCDMFKDFIDKFTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C070 | 166 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDHPLYIQNLKV<br>RFRLKERHIPCIQVKQSSLFIQTEYLESSVNKLGVDELIDLTVTNVDLDLFFEHYDIL<br>EIHFTYGYMFKASCDMFKDFIDKFTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C071 | 167 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYQGEYKENIQHPLYIQNLKV<br>RFRLKERHIPCIQVKQNSLFIQTEYLENSVNKLGVDELIELTVTNVDLDLFFEHYEIL<br>EIHFTYGYMFRGSCDMFKDFIDKFTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C072 | 168 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYQGEYKENIQYPLYIQNLKV<br>RFRLKERHIPTIQVKQNSLFIQTEYLENSVNKLGVDELIELTVTNVDLDLFFEHYEIL<br>EIHFTYGYMFRASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C073 | 169 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIDYPLYIQNIKVRFR<br>LKERHIPCIQVKQSSLFIQNEYLESSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C074 | 170 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQYPLYIQNIKVRFR<br>LKERHIPTIQVKQNSLFIQNEYLENSVNKLGVDELIDLTVTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |

TABLE 3-continued

Chimeric Polymerase Variants

| Name | SEQ ID NO | Sequence |
|---|---|---|
| C075 | 171 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQYPLYIQNIKVRFR<br>LKERHIPTIQVKQNSLFIQNEYLENSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C076 | 172 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQNEYLESSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C077 | 173 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQNEYLESSVNKLGVDELIDLTVTNVDLDLFFEHYDILEIH<br>FTYGYMFKASCDMFKDFIDKFTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C078 | 174 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIDHPLYIQNLKVRFR<br>LKERHIPTIQVKQNSLFIQNEYLENSVNKLGVDELIDLTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C079 | 175 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQHPLYIQNLKVRFR<br>LKERHIPTIQVKQNSLFIQNEYLENSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C080 | 176 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQYPLYIQNLKVRFR<br>LKERHIPCIQVKQNSLFIQNEYLENSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C081 | 177 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQYPLYIQNLKVRFR<br>LKERHIPTIQVKQNSLFIQNEYLENSVNKLGVDELIELTVTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL |

TABLE 3-continued

Chimeric Polymerase Variants

| Name | SEQ ID NO | Sequence |
|---|---|---|
| | | TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C082 | 178 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQHPLYIQNLKVRFR<br>LKERHIPCIQVKQNSLFIQNEYLENSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C083 | 179 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQHPLYIQNLKVRFR<br>LKERHIPCIQVKQNSLFIQNEYLENSVNKLGVDELIELTVTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C084 | 180 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQHPLYIQNLKVRFR<br>LKERHIPCIQVKQNSLFIQNEYLENSVNKLGVDELIELTVTNVDLDLFFEHYEILEIH<br>FTYGYMFRASCDMFKDFIDKFTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C085 | 181 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYQGEYKENIQHPLYIQNLKV<br>RFRLKERHIPCIQVKQNSLFIQNEYLENSVNKLGVDELIELTLTNVDLDLFFEHYEIL<br>EIHYTYGYMFRASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C086 | 182 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYQGEYKENIQHPLYIQNLKV<br>RFRLKERHIPCIQVKQNSLFIQNEYLENSVNKLGVDELIELTVTNVDLDLFFEHYEIL<br>EIHYTYGYMFRASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C087 | 183 | MSRKMFSCDFETTTKLDDCRVWAYGYMEIGNLDNYKIGNSLDEFMQWVMEIQADLYFH<br>DLKFDGAFIVNWLERNGFKWSNEGLPNTYNTIISKMGQWYMIDICIGYKGKRKLHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQYPLYIQNLKVRFR<br>LKERHIPTIQVKQNSLFIQNEYLENSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C088 | 184 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQYPLYIQNLKVRFR<br>LKERHIPTIQVKQNSLFIQNEYLENSVNKLGVDELIELTLTNVDLDLFFEHYEILEIH |

TABLE 3-continued

Chimeric Polymerase Variants

| Name | SEQ ID NO | Sequence |
|---|---|---|
| | | YTYGYMFRASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTEIPDVIKDIVDPKKLGYWEHESTFKRAKYLRQKTYIQDIYVKEVDGKLKECSPDE<br>ATDIKFSVKCAGMTDKIKKEVTFENFKVGFSRKMKPKPVQVPGGVVLVDETFTIK |
| C089 | 185 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQYPLYIQNLKVRFR<br>LKERHIPTIQVKQNSLFIQNEYLENSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYVPLASFVTAWGRYTTITTAQRCFDNIIYCDTDSIHL<br>TGTEIPDVIKDIVDPKKLGYWEHESTFKRAKYLRQKTYIQDIYVKRVDGYLVECSPDE<br>YTDIKFSVKCAGMTDKIKKEVTFENFKVGFSRKMKPKPVQVPGGVVLVDETFTIK |
| C090 | 186 | MSRKMFSCDFETTTKLDDCRVWAYGYMEIGNLDNYKIGNSLDEFMQWVMEIQADLYFH<br>DLKFDGAFIVNWLEQHGFKWSNEGLPNTYNTIISKMGQWYMIDICFGYKGKRKLHTVI<br>YDSLKKLPFPVKKIAKDFQLPLLKGDIDYHTERPVGHEITPEEYEYIKNDIEIIARAL<br>DIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQYPLYIQNLKVRFR<br>LKERHIPTIQVKQNSLFIQNEYLENSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTEIPDVIKDIVDPKKLGYWEHESTFKRAKYLRQKTYIQDIYVKRVDGYLVECSPDE<br>YTDIKFSVKCAGMTDKIKKEVTFENFKVGFSRKMKPKPVQVPGGVVLVDETFTIK |
| C091 | 187 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIDHPLYIQNLKVRFR<br>LKERHIPTIQVKQNSLFIQNEYLENSVNKLGVDELIDLTLTNVDLDLFFEHYEILEIH<br>FTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C092 | 188 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPCIQVKQSSLFIQTEYLESSVNKLGVDELIELTLTNVDLDLFFEHYEILEIH<br>FTYGYMFRGSCDMFKDFIDKFTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C093 | 189 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQYPLYIQNIKVRFR<br>LKERHIPTIQVKQNSLFIQNEYLENSVNKLGVDELIELTLTNVDLDLFFEHYEILEIH<br>YTYGYMFRGSCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C094 | 190 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQTEYLESSVNKLGVDELIELTLTNVDLDLFFEHYEILEIH<br>YTYGYMFRGSCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C095 | 191 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND |

TABLE 3-continued

Chimeric Polymerase Variants

| Name | SEQ ID NO | Sequence |
|---|---|---|
| | | RFKGKEIGEGMVFDANSHYPAQMYVRPLPYGTPLFYQGEYKENIQYPLYIQNIKVRFR<br>LKERHIPTIQVKQNSLFIQTEYLENSVNKLGVDELIDLTVTNVDLDLFFEHYDILEIH<br>FTYGYMFKASCDMFKDFIDKFTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C096 | 192 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQTEYLESSVNKLGVDELIDLTVTNVDLDLFFEHYDILEIH<br>FTYGYMFKASCDMFKDFIDKFTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C097 | 193 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQHPLYIQNLKVRFR<br>LKERHIPCIQVKQNSLFIQTEYLENSVNKLGVDELIELTVTNVDLDLFFEHYEILEIH<br>FTYGYMFRGSCDMFKDFIDKFTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C098 | 194 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIQYPLYIQNLKVRFR<br>LKERHIPTIQVKQNSLFIQTEYLENSVNKLGVDELIELTVTNVDLDLFFEHYEILEIH<br>FTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C099 | 195 | MSRKMFSCDFETTTKLDDCRVWAYGYMEIGNLDNYKIGNSLDEFMQWVMEIQADLYFH<br>DLKFDGAFIVNWLEKNGFKWSAEGLPNTYNTIISRMGQWYMIDICFGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0100 | 196 | MSRKMFSCDFETTTKLDDCRVWAYGYMEIGNLDNYKIGNSLDEFMQWVMEIQADLYFH<br>DLKFDGAFIVNWLEKNGFKWSAEGLPNTYNTIISRMGQWYMIDICIGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0101 | 197 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKLHTII<br>YDSLKKLPFPVEKIAKDFKLTLKKGDIDIHKERPIGYKITPDEYAYLKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0102 | 198 | MSRKMFSCDFETTTKLDDCRVWAYGYMEIGNLDNYKIGNSLDEFMQWVMEIQADLYFH<br>DLKFDGAFIVNWLEKNGFKWSAEGLPNTYNTIISRMGQWYMIDICFGYKGKRKLHTII |

TABLE 3-continued

Chimeric Polymerase Variants

| Name | SEQ ID NO | Sequence |
|---|---|---|
| | | YDSLKKLPPPVEKIAKDFKLTLKKGDIDIHKERPIGYKITPDEYAYLKNDIQIIAEAL |
| | | LIQFKQGLDRMTAGSDSLKGFKDIITTKKFKKVFPTLSLGLDKEVRKAYRGGFTWLND |
| | | RFKGKEIGEGMVFDANSHYPAQMYVRPLPYGTPLFYEGEYKENIDYPLYIQNIKVRFR |
| | | LKERHIPTIQVKQSSLFIQNEYLESSVNKLGVDELIDLTLTNVDLDLFFEHYDILEIH |
| | | YTYGYMFKASCDMFKDFIDKWTYIKTTSYGAIKQLAKLMLNSLYGKFASNPDVTGKVP |
| | | YLKENGALGFRLGEEETKDPVYTPMGVFITAWGRYTTITAAQACYDRIIYCDTDSIHL |
| | | TGTEIPDVIKDIVDPKKLGYWEHESTFKRAKYLRQKTYIQDIYMKRVKGYLVQGSPDD |
| | | YTDIKFSVKCAGMTDKIKKEVTFENFKVGFSRKMKPKPVQVPGGVVLVDETFTIK |
| C0103 | 199 | MSRKMFSCDFETTTKLDDCRVWAYGYMEIGNLDNYKIGNSLDEFMQWVMEIQADLYFH |
| | | DLKFDGAFIVNWLEKNGFKWSAEGIPNTYNTIISRMGQWYMIDICFGYKGKRKLHTII |
| | | YDSLKKLPPPVEKIAKDFKLTLKKGDIDIHKERPIGYKITPDEYAYLKNDIQILAEAL |
| | | LIQFKQGLDRMTAGSDSLKGFKDIITTKKFKKVFPTLSLGLDKEVRKAYRGGFTWLND |
| | | RFKGKEIGEGMVFDANSHYPAQMYVRPLPYGTPLFYEGEYKENIDYPLYIQNIKVRFR |
| | | LKERHIPTIQVKQSSLFIQNEYLESSVNKLGVDELIDLTLTNVDLDLFFEHYDILEIH |
| | | YTYGYMFKASCDMFKDFIDKWTYIKTTSYGAIKQLAKLMLNSLYGKFASNPDVTGKVP |
| | | YLKENGALGFRLGEEETKDPVYTPMGVFITAWGRYTTITAAQACYDRIIYCDTDSIHL |
| | | TGTEIPDVIKDIVDPKKLGYWEHESTFKRAKYLRQKTYIQDIYMKRVKGYLVQGSPDD |
| | | YTDIKFSVKCAGMTDKIKKEVTFENFKVGFSRKMKPKPVQVPGGVVLVDETFTIK |
| C0104 | 200 | MSRKMFSCDFETTTKLDDCRVWAYGYMEIGNLDNYKIGNSLDEFMQWVMEIQADLYFH |
| | | DLKFDGAFIINWLEQHGFKWSNEGLPNTYNTIISRMGQWYMIDICLGYKGKRKIHTVI |
| | | YDSLKKLPPPVEKIAKDFKLTVKKGDIDIHKERPVGYKITPEEYAYIKNDIQIIAEAL |
| | | LIQFKQGLDRMTAGSDSLKGFKDIITTKKFKKVFPTLSLGLDKEVRKAYRGGFTWLND |
| | | RFKGKEIGEGMVFDANSHYPAQMYVRPLPYGTPLFYEGEYKENIDYPLYIQNIKVRFR |
| | | LKERHIPTIQVKQSSLFIQNEYLESSVNKLGVDELIDLTLTNVDLDLFFEHYDILEIH |
| | | YTYGYMFKASCDMFKDFIDKWTYIKTTSYGAIKQLAKLMLNSLYGKFASNPDVTGKVP |
| | | YLKENGALGFRLGEEETKDPVYTPMGVFITAWGRYTTITAAQACYDRIIYCDTDSIHL |
| | | TGTEIPDVIKDIVDPKKLGYWEHESTFKRAKYLRQKTYIQDIYMKRVKGYLVQGSPDD |
| | | YTDIKFSVKCAGMTDKIKKEVTFENFKVGFSRKMKPKPVQVPGGVVLVDETFTIK |
| C0105 | 201 | MSRKMFSCDFETTTKLDDCRVWAYGYMEIGNLDNYKIGNSLDEFMQWVMEIQADLYFH |
| | | DLKFDGAFIINWLFKNGFKWCKEAKEERTFSTIISRMGQWYMIDICLGYKGKRKIHTV |
| | | IYDSLKKLPPPVEKIAKDFKLTVKKGDIDIHKERPVGYKITPEEYAYIKNDIQIIAEA |
| | | LLIQFKQGLDRMTAGSDSLKGFKDIITTKKFKKVFPTLSLGLDKEVRKAYRGGFTWLN |
| | | DRFKGKEIGEGMVFDANSHYPAQMYVRPLPYGTPLFYEGEYKENIDYPLYIQNIKVRF |
| | | RLKERHIPTIQVKQSSLFIQNEYLESSVNKLGVDELIDLTLTNVDLDLFFEHYDILEI |
| | | HYTYGYMFKASCDMFKDFIDKWTYIKTTSYGAIKQLAKLMLNSLYGKFASNPDVTGKV |
| | | PYLKENGALGFRLGEEETKDPVYTPMGVFITAWGRYTTITAAQACYDRIIYCDTDSIH |
| | | LTGTEIPDVIKDIVDPKKLGYWEHESTFKRAKYLRQKTYIQDIYMKRVKGYLVQGSPD |
| | | DYTDIKFSVKCAGMTDKIKKEVTFENFKVGFSRKMKPKPVQVPGGVVLVDETFTIK |
| C0106 | 202 | MSRKMFSCDFETTTKLDDCRVWAYGYMEIGNLDNYKIGNSLDEFMQWVMEIQADLYFH |
| | | DLKFDGAFIINWLLHNGYTWTKRPSKEGQFSTIISRMGQWYMIDICLGYKGKRKIHTV |
| | | IYDSLKKLPPPVEKIAKDFKLTVKKGDIDIHKERPVGYKITPEEYAYIKNDIQIIAEA |
| | | LLIQFKQGLDRMTAGSDSLKGFKDIITTKKFKKVFPTLSLGLDKEVRKAYRGGFTWLN |
| | | DRFKGKEIGEGMVFDANSHYPAQMYVRPLPYGTPLFYEGEYKENIDYPLYIQNIKVRF |
| | | RLKERHIPTIQVKQSSLFIQNEYLESSVNKLGVDELIDLTLTNVDLDLFFEHYDILEI |
| | | HYTYGYMFKASCDMFKDFIDKWTYIKTTSYGAIKQLAKLMLNSLYGKFASNPDVTGKV |
| | | PYLKENGALGFRLGEEETKDPVYTPMGVFITAWGRYTTITAAQACYDRIIYCDTDSIH |
| | | LTGTEIPDVIKDIVDPKKLGYWEHESTFKRAKYLRQKTYIQDIYMKRVKGYLVQGSPD |
| | | DYTDIKFSVKCAGMTDKIKKEVTFENFKVGFSRKMKPKPVQVPGGVVLVDETFTIK |
| C0107 | 203 | MSRKMFSCDFETTTKLDDCRVWAYGYMEIGNLDNYKIGNSLDEFMQWVMEIQADLYFH |
| | | DLKFDGAFIINWLLHKGYECNESGRPKTFDTIISRMGQWYMIDICLGYKGKRKIHTVI |
| | | YDSLKKLPPPVEKIAKDFKLTVKKGDIDIHKERPVGYKITPEEYAYIKNDIQIIAEAL |
| | | LIQFKQGLDRMTAGSDSLKGFKDIITTKKFKKVFPTLSLGLDKEVRKAYRGGFTWLND |
| | | RFKGKEIGEGMVFDANSHYPAQMYVRPLPYGTPLFYEGEYKENIDYPLYIQNIKVRFR |
| | | LKERHIPTIQVKQSSLFIQNEYLESSVNKLGVDELIDLTLTNVDLDLFFEHYDILEIH |
| | | YTYGYMFKASCDMFKDFIDKWTYIKTTSYGAIKQLAKLMLNSLYGKFASNPDVTGKVP |
| | | YLKENGALGFRLGEEETKDPVYTPMGVFITAWGRYTTITAAQACYDRIIYCDTDSIHL |
| | | TGTEIPDVIKDIVDPKKLGYWEHESTFKRAKYLRQKTYIQDIYMKRVKGYLVQGSPDD |
| | | YTDIKFSVKCAGMTDKIKKEVTFENFKVGFSRKMKPKPVQVPGGVVLVDETFTIK |
| C0108 | 204 | MSRKMFSCDFETTTKLDDCRVWAYGYMEIGNLDNYKIGNSLDEFMQWVMEIQADLYFH |
| | | DLKFDGAFIINWLLKHGYRWTKENPGVKEFTTIISRMGQWYMIDICLGYKGKRKIHTV |
| | | IYDSLKKLPPPVEKIAKDFKLTVKKGDIDIHKERPVGYKITPEEYAYIKNDIQIIAEA |
| | | LLIQFKQGLDRMTAGSDSLKGFKDIITTKKFKKVFPTLSLGLDKEVRKAYRGGFTWLN |
| | | DRFKGKEIGEGMVFDANSHYPAQMYVRPLPYGTPLFYEGEYKENIDYPLYIQNIKVRF |
| | | RLKERHIPTIQVKQSSLFIQNEYLESSVNKLGVDELIDLTLTNVDLDLFFEHYDILEI |
| | | HYTYGYMFKASCDMFKDFIDKWTYIKTTSYGAIKQLAKLMLNSLYGKFASNPDVTGKV |
| | | PYLKENGALGFRLGEEETKDPVYTPMGVFITAWGRYTTITAAQACYDRIIYCDTDSIH |
| | | LTGTEIPDVIKDIVDPKKLGYWEHESTFKRAKYLRQKTYIQDIYMKRVKGYLVQGSPD |
| | | DYTDIKFSVKCAGMTDKIKKEVTFENFKVGFSRKMKPKPVQVPGGVVLVDETFTIK |

TABLE 3-continued

Chimeric Polymerase Variants

| Name | SEQ ID NO | Sequence |
|---|---|---|
| C0109 | 205 | MSRKMFSCDFETTTKLDDCRVWAYGYMEIGNLDNYKIGNSLDEFMQWVMEIQADLYFH
DLKFDGAFIINWLFKNGFKWCKEAKEERTFSTIISRMGQWYMIDICLGYKGKRKIHTV
IYDSLKKLPFPVEKIAKDFKLTVKKGDIDIHKERPVGYKITPEEYAYIKNDIQIIAEA
LLIQFKQGLDRMTAGSDSLKGFKDIITTKKFKKVFPTLSLGLDKEVRKAYRGGFTWLN
DRFKGKEIGEGMVFDANSHYPAQMYVRPLPYGTPLFYEGEYKENIDYPLYIQNIKVRF
RLKERHIPTIQVKQSSLFIQNEYLESSVNKLGVDELIDLTLTNVDLDLFFEHYDILEI
HYTYGYMFKASCDMFKDFIDKWTYIKTTSYGAIKQLAKLMLNSLYGKFASNPDVTGKV
PYLKENGALGFRLGEEETKDPVYTPMGVFITAWGRYTTITAAQACYDRIIYCDTDSIH
LTGTEIPDVIKDIVDPKKLGYWEHESTFKRAKYLRQKTYIQDIYMKRVKGYLVQGSPD
DYTDIKFSVKCAGMTDKIKKEVTFENFKVGFSRKMKPKPVQVPGGVVLVDETFTIK |
| C0110 | 206 | MSRKMFSCDFETTTKLDDCRVWAYGYMEIGNLDNYKIGNSLDEFMQWVMEIQADLYFH
DLKFDGAFIINWLEKNGFKWTAEGEPNTYSTIISRMGQWYMIDICLGYKGKRKIHTVI
YDSLKKLPFPVEKIAKDFKLTVKKGDIDIHKERPVGYKITPEEYAYIKNDIQIIAEAL
LIQFKQGLDRMTAGSDSLKGFKDIITTKKFKKVFPTLSLGLDKEVRKAYRGGFTWLND
RFKGKEIGEGMVFDANSHYPAQMYVRPLPYGTPLFYEGEYKENIDYPLYIQNIKVRFR
LKERHIPTIQVKQSSLFIQNEYLESSVNKLGVDELIDLTLTNVDLDLFFEHYDILEIH
YTYGYMFKASCDMFKDFIDKWTYIKTTSYGAIKQLAKLMLNSLYGKFASNPDVTGKVP
YLKENGALGFRLGEEETKDPVYTPMGVFITAWGRYTTITAAQACYDRIIYCDTDSIHL
TGTEIPDVIKDIVDPKKLGYWEHESTFKRAKYLRQKTYIQDIYMKRVKGYLVQGSPDD
YTDIKFSVKCAGMTDKIKKEVTFENFKVGFSRKMKPKPVQVPGGVVLVDETFTIK |
| C0111 | 207 | MSRKMFSCDFETTTKLDDCRVWAYGYMEIGNLDNYKIGNSLDEFMQWVMEIQADLYFH
DLKFDGAFIINWLLKNGFKWTAEGLPRTYSTIISRMGQWYMIDICLGYKGKRKIHTVI
YDSLKKLPFPVEKIAKDFKLTVKKGDIDIHKERPVGYKITPEEYAYIKNDIQIIAEAL
LIQFKQGLDRMTAGSDSLKGFKDIITTKKFKKVFPTLSLGLDKEVRKAYRGGFTWLND
RFKGKEIGEGMVFDANSHYPAQMYVRPLPYGTPLFYEGEYKENIDYPLYIQNIKVRFR
LKERHIPTIQVKQSSLFIQNEYLESSVNKLGVDELIDLTLTNVDLDLFFEHYDILEIH
YTYGYMFKASCDMFKDFIDKWTYIKTTSYGAIKQLAKLMLNSLYGKFASNPDVTGKVP
YLKENGALGFRLGEEETKDPVYTPMGVFITAWGRYTTITAAQACYDRIIYCDTDSIHL
TGTEIPDVIKDIVDPKKLGYWEHESTFKRAKYLRQKTYIQDIYMKRVKGYLVQGSPDD
YTDIKFSVKCAGMTDKIKKEVTFENFKVGFSRKMKPKPVQVPGGVVLVDETFTIK |
| C0112 | 208 | MSRKMFSCDFETTTKLDDCRVWAYGYMEIGNLDNYKIGNSLDEFMQWVMEIQADLYFH
DLKFDGAFIINWLFKNGYKWTAEGLPNTFSTIISRMGQWYMIDICLGYKGKRKIHTVI
YDSLKKLPFPVEKIAKDFKLTVKKGDIDIHKERPVGYKITPEEYAYIKNDIQIIAEAL
LIQFKQGLDRMTAGSDSLKGFKDIITTKKFKKVFPTLSLGLDKEVRKAYRGGFTWLND
RFKGKEIGEGMVFDANSHYPAQMYVRPLPYGTPLFYEGEYKENIDYPLYIQNIKVRFR
LKERHIPTIQVKQSSLFIQNEYLESSVNKLGVDELIDLTLTNVDLDLFFEHYDILEIH
YTYGYMFKASCDMFKDFIDKWTYIKTTSYGAIKQLAKLMLNSLYGKFASNPDVTGKVP
YLKENGALGFRLGEEETKDPVYTPMGVFITAWGRYTTITAAQACYDRIIYCDTDSIHL
TGTEIPDVIKDIVDPKKLGYWEHESTFKRAKYLRQKTYIQDIYMKRVKGYLVQGSPDD
YTDIKFSVKCAGMTDKIKKEVTFENFKVGFSRKMKPKPVQVPGGVVLVDETFTIK |
| C0113 | 209 | MSRKMFSCDFETTTKLDDCRVWAYGYMEIGNLDNYKIGNSLDEFMQWVMEIQADLYFH
DLKFDGAFIINWLEKNGYKWTAEGLPKTFSTIISRMGQWYMIDICLGYKGKRKIHTVI
YDSLKKLPFPVEKIAKDFKLTVKKGDIDIHKERPVGYKITPEEYAYIKNDIQIIAEAL
LIQFKQGLDRMTAGSDSLKGFKDIITTKKFKKVFPTLSLGLDKEVRKAYRGGFTWLND
RFKGKEIGEGMVFDANSHYPAQMYVRPLPYGTPLFYEGEYKENIDYPLYIQNIKVRFR
LKERHIPTIQVKQSSLFIQNEYLESSVNKLGVDELIDLTLTNVDLDLFFEHYDILEIH
YTYGYMFKASCDMFKDFIDKWTYIKTTSYGAIKQLAKLMLNSLYGKFASNPDVTGKVP
YLKENGALGFRLGEEETKDPVYTPMGVFITAWGRYTTITAAQACYDRIIYCDTDSIHL
TGTEIPDVIKDIVDPKKLGYWEHESTFKRAKYLRQKTYIQDIYMKRVKGYLVQGSPDD
YTDIKFSVKCAGMTDKIKKEVTFENFKVGFSRKMKPKPVQVPGGVVLVDETFTIK |
| C0114 | 210 | MSRKMFSCDFETTTKLDDCRVWAYGYMEIGNLDNYKIGNSLDEFMQWVMEIQADLYFH
DLKFDGAFIINWLLRNGYVHTEEDRTNTPKEFTTIISRMGQWYMIDICLGYKGKRKIH
TVIYDSLKKLPFPVEKIAKDFKLTVKKGDIDIHKERPVGYKITPEEYAYIKNDIQIIA
EALLIQFKQGLDRMTAGSDSLKGFKDIITTKKFKKVFPTLSLGLDKEVRKAYRGGFTW
LNDRFKGKEIGEGMVFDANSHYPAQMYVRPLPYGTPLFYEGEYKENIDYPLYIQNIKV
RFRLKERHIPTIQVKQSSLFIQNEYLESSVNKLGVDELIDLTLTNVDLDLFFEHYDIL
EIHYTYGYMFKASCDMFKDFIDKWTYIKTTSYGAIKQLAKLMLNSLYGKFASNPDVTG
KVPYLKENGALGFRLGEEETKDPVYTPMGVFITAWGRYTTITAAQACYDRIIYCDTDS
IHLTGTEIPDVIKDIVDPKKLGYWEHESTFKRAKYLRQKTYIQDIYMKRVKGYLVQGS
PDDYTDIKFSVKCAGMTDKIKKEVTFENFKVGFSRKMKPKPVQVPGGVVLVDETFTIK |
| C0115 | 211 | MSRKMFSCDFETTTKLDDCRVWAYGYMEIGNLDNYKIGNSLDEFMQWVMEIQADLYFH
DLKFDGAFIINWLFRLGYEFTDEKAPQVKEFSTIISRMGQWYMIDICLGYKGKRKIHT
VIYDSLKKLPFPVEKIAKDFKLTVKKGDIDIHKERPVGYKITPEEYAYIKNDIQIIAE
ALLIQFKQGLDRMTAGSDSLKGFKDIITTKKFKKVFPTLSLGLDKEVRKAYRGGFTWL
NDRFKGKEIGEGMVFDANSHYPAQMYVRPLPYGTPLFYEGEYKENIDYPLYIQNIKVR
FRLKERHIPTIQVKQSSLFIQNEYLESSVNKLGVDELIDLTLTNVDLDLFFEHYDILE
IHYTYGYMFKASCDMFKDFIDKWTYIKTTSYGAIKQLAKLMLNSLYGKFASNPDVTGK
VPYLKENGALGFRLGEEETKDPVYTPMGVFITAWGRYTTITAAQACYDRIIYCDTDSI |

TABLE 3-continued

Chimeric Polymerase Variants

| Name | SEQ ID NO | Sequence |
|---|---|---|
| | | HLTGTEIPDVIKDIVDPKKLGYWEHESTFKRAKYLRQKTYIQDIYMKRVKGYLVQGSP<br>DDYTDIKFSVKCAGMTDKIKKEVTFENFKVGFSRKMKPKPVQVPGGVVLVDETFTIK |
| C0116 | 212 | MSRKMFSCDFETTTKLDDCRVWAYGYMEIGNLDNYKIGNSLDEFMQWVMEIQADLYFH<br>DLKFDGAFIINWLLTDGWKWIPDKNDCANRTFTTIISRMGQWYMIDICLGYKGKRKIH<br>TVIYDSLKKLPFFVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C0117 | 213 | MSRKMFSCDFETTTKLDDCRVWAYGYMEIGNLDNYKIGNSLDEFMQWVMEIQADLYFH<br>DLKFDGAFIINWLLENGFKHSRERALYSNEFSTIISRMGQWYMIDICLGYKGKRKNEFSTI<br>VIYDSLKKLPFPVEKIAKDFKLTVKKGDIDIHKERPVGYKITPEEYAYIKNDIQIIAE<br>ALLIQFKQGLDRMTAGSDSLKGFKDIITTKKFKKVFPTLSLGLDKEVRKAYRGGFTWL<br>NDRFKGKEIGEGMVFDANSHYPAQMYVRPLPYGTPLFYEGEYKENIDYPLYIQNIKVR<br>FRLKERHIPTIQVKQSSLFIQNEYLESSVNKLGVDELIDLTLTNVDLDLFFEHYDILE<br>IHYTYGYMFKASCDMFKDFIDKWTYIKTTSYGAIKQLAKLMLNSLYGKFASNPDVTGK<br>VPYLKENGALGFRLGEEETKDPVYTPMGVFITAWGRYTTITAAQACYDRIIYCDTDSI<br>HLTGTEIPDVIKDIVDPKKLGYWEHESTFKRAKYLRQKTYIQDIYMKRVKGYLVQGSP<br>DDYTDIKFSVKCAGMTDKIKKEVTFENFKVGFSRKMKPKPVQVPGGVVLVDETFTIK |
| C0118 | 214 | MSRKMFSCDFETTTKLDDCRVWAYGYMEIGNLDNYKIGNSLDEFMQWVMEIQADLYFH<br>DLKFDGAFIINWLLGVAKWEYNDKPKARKAKTVETIISRMGQWYMIDICLGYKGKRKI<br>HTVIYDSLKKLPFFVEKIAKDFKLTVKKGDIDIHKERPVGYKITPEEYAYIKNDIQII<br>AEALLIQFKQGLDRMTAGSDSLKGFKDIITTKKFKKVFPTLSLGLDKEVRKAYRGGFT<br>WLNDRFKGKEIGEGMVFDANSHYPAQMYVRPLPYGTPLFYEGEYKENIDYPLYIQNIK<br>VRFRLKERHIPTIQVKQSSLFIQNEYLESSVNKLGVDELIDLTLTNVDLDLFFEHYDI<br>LEIHYTYGYMFKASCDMFKDFIDKWTYIKTTSYGAIKQLAKLMLNSLYGKFASNPDVT<br>GKVPYLKENGALGFRLGEEETKDPVYTPMGVFITAWGRYTTITAAQACYDRIIYCDTD<br>SIHLTGTEIPDVIKDIVDPKKLGYWEHESTFKRAKYLRQKTYIQDIYMKRVKGYLVQG<br>SPDDYTDIKFSVKCAGMTDKIKKEVTFENFKVGFSRKMKPKPVQVPGGVVLVDETFTI<br>K |
| C0119 | 215 | MSRKMYSADFETTTKLDDCRVWSYGYMEVGNLDNYKIGNDIDEFMQWVMEIQSDLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0120 | 216 | MSRKMYSCDFETTTKLDDCRVWAYGVMEVGNLDNYKIGNDIDEFMQWIMEIQSDLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0121 | 217 | MSRKVFTADFETTTKLDDCRVWAYGWMEVGNLDNYKIGNSIDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0122 | 218 | MSRKVYTADFETTTKLDDCRVWAYGWMEVGNLDNYKIGNSIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR |

TABLE 3-continued

Chimeric Polymerase Variants

| Name | SEQ ID NO | Sequence |
|---|---|---|
| | | LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0123 | 219 | MSRKMYTADFETTTKLDDCRVWAYGYMEVGNLDNYKIGNDIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0124 | 220 | MSRKMYSADFETTTKLDDCRVWAYGYMEVGNLDNYKIGNSIDEFMQWIMEIQSDLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0125 | 221 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWFYIKTTSEGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWAHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C0126 | 222 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWFYIKTTSEGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWNHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C0127 | 223 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWFYIKTTSEGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWQHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C0128 | 224 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTRSEGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWAHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C0129 | 225 | MSRKRFSCDFETTTKLDDCRVWAYGYMEIGNLDNYKIGNSLDEFMQWAMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL |

TABLE 3-continued

Chimeric Polymerase Variants

| Name | SEQ ID NO | Sequence |
|---|---|---|
| | | LIQFKQGLDRMTAGSDSLKDFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0130 | 226 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLEEETKDPVYTPMGVFITAWGRYTTITAAQACYDRIIYCDTDSIHL<br>TGTKIPDVIKDIVHPKKLGYWEHESTFKRAKYLRQKTYIQDIYMKRVKGYLVQGSPDD<br>YTDIKFSVKCAGMTDKIKEEVTFENFKVGFSRKMKPKPVQVPGGVVLVDSVFTIK |
| C0131 | 227 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLEEETKDPVYTPMGVFITAWGRFTTITAAQACYDRIIYCDTDSIHL<br>TGTKIPDVIKDIVHPKKLGYWEHESTFKRAKYLRQKTYIQDIYMKRVKGYLVQGSPDD<br>YTDIKFSVKCAGMTDKIKEEVTFDNFKVGFSRKMKPKPVQVPGGVVLVDSVFTIK |
| C0132 | 228 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQNEYLESSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLEEETKDPVYTPLASFVTAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0133 | 229 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIQYPLYIQNIKVRFR<br>LKERHIPTIQVKQSSLFIQNEYLESSVNKLGVDELIDLTLTNVDLDLFFEHYDILEIH<br>YTYGYMFRASCDMFKDFIDKWTYIKTTSYGAIKQLAKLMLNSLYGKFASNPDVTGKVP<br>YLKENGALGFRLEEETKDPVYTPMGVFITAWGRFTTITAAQACYDRIIYCDTDSIHL<br>TGTKIPDVIKDIVHPKKLGYWEHESTFKRAKYLRQKTYIQDIYMKRVKGYLVQGSPDD<br>YTDIKFSVKCAGMTDKIKEEVTFDNFKVGFSRKMKPKPVQVPGGVVLVDSVFTIK |
| C0134 | 230 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAQDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDINSHYPAQMYVRPLPYGTPLFYEGEYKENIQYPLYIQNIKVRFR<br>LKERHIPTIQVKQSSLFIQNEYLESSVNKLGVDELIDLTLTNVDLDLFFEHYDILEIH<br>YTYGYMFRASCDMFKDFIDKWTYIKTTSYGAIKQLAKLMLNSLYGKFASNPDVTGKVP<br>YLKENGALGFRLEEETKDPVYTPMGVFITAWGRFTTITAAQACYDRIIYCDTDSIHL<br>TGTKIPDVIKDIVHPKKLGYWEHESTFKRAKYLRQKTYIQDIYMKRVKGYLVQGSPDD<br>YTDIKFSVKCAGMTDKIKEEVTFDNFKVGFSRKMKPKPVQVPGGVVLVDSVFTIK |
| C0135 | 231 | MSRKRFSCDFETTTKLDDCRVWAYGYMEIGNLDNYKIGNSLDEFMQWAMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLEEETKDPVYTPMGVFITAWGRYTTITAAQACYDRIIYCDTDSIHL<br>TGTKIPDVIKDIVHPKKLGYWEHESTFKRAKYLRQKTYIQDIYMKRVKGYLVQGSPDD<br>YTDIKFSVKCAGMTDKIKEEVTFENFKVGFSRKMKPKPVQVPGGVVLVDSVFTIK |

TABLE 3-continued

Chimeric Polymerase Variants

| Name | SEQ ID NO | Sequence |
|---|---|---|
| C0136 | 232 | MSRKRFSCDFETTTKLDDCRVWAYGYMEIGNLDNYKIGNSLDEFMQWAMEIQADLYFH
DLKFDGAFIINWLERNGFKWSADGLPNTYNTIISRMGQWYMIDICLGYKGKRKIHTVI
YDSLKKLPFPVEKIAKDFKLTVKKGDIDIHKERPVGYKITPEEYAYIKNDIQIIAEAL
LIQFKQGLDRMTAGSDSLKDFKDIITTKKFKKVFPTLSLGLDKEVRKAYRGGFTWLND
RFKGKEIGEGMVFDANSHYPAQMYVRPLPYGTPLFYEGEYKENIQYPLYIQNIKVRFR
LKERHIPTIQVKQSSLFIQNEYLESSVNKLGVDELIDLTLTNVDLDLFFEHYDILEIH
YTYGYMFRASCDMFKDFIDKWTYIKTTSYGAIKQLAKLMLNSLYGKFASNPDVTGKVP
YLKENGALGFRLGEEETKDPVYTPMGVFITAWGRFTTITAAQACYDRIIYCDTDSIHL
TGTKIPDVIKDIVHPKKLGYWEHESTFKRAKYLRQKTYIQDIYMKRVKGYLVQGSPDD
YTDIKFSVKCAGMTDKIKEEVTFDNFKVGFSRKMKPKPVQVPGGVVLVDSVFTIK |
| C0137 | 233 | MSRKRFSCDFETTTKLDDCRVWAYGYMEIGNLDNYKIGNSLDEFMQWAMEIQADLYFH
DLKFDGAFIINWLERNGFKWSADGLPNTYNTIISRMGQWYMIDICLGYKGKRKIHTVI
YDSLKKLPFPVEKIAQDFKLTVKKGDIDIHKERPVGYKITPEEYAYIKNDIQIIAEAL
LIQFKQGLDRMTAGSDSLKDFKDIITTKKFKKVFPTLSLGLDKEVRKAYRGGFTWLND
RFKGKEIGEGMVFDINSHYPAQMYVRPLPYGTPLFYEGEYKENIQYPLYIQNIKVRFR
LKERHIPTIQVKQSSLFIQNEYLESSVNKLGVDELIDLTLTNVDLDLFFEHYDILEIH
YTYGYMFRASCDMFKDFIDKWTYIKTTSYGAIKQLAKLMLNSLYGKFASNPDVTGKVP
YLKENGALGFRLGEEETKDPVYTPMGVFITAWGRFTTITAAQACYDRIIYCDTDSIHL
TGTKIPDVIKDIVHPKKLGYWEHESTFKRAKYLRQKTYIQDIYMKRVKGYLVQGSPDD
YTDIKFSVKCAGMTDKIKEEVTFDNFKVGFSRKMKPKPVQVPGGVVLVDSVFTIK |
| C0138 | 234 | MSRKRFSCDFETTTKLDDCRVWAYGYMEIGNLDNYKIGNSLDEFMQWAMEIQADLYFH
DLKFDGAFIINWLERNGFKWSADGLPNTYNTIISRMGQWYMIDICLGYKGKRKIHTVI
YDSLKKLPFPVEKIAKDFKLTVKKGDIDIHKERPVGYKITPEEYAYIKNDIQIIAEAL
LIQFKQGLDRMTAGSDSLKDFKDIITTKKFKKVFPTLSLGLDKEVRKAYRGGFTWLND
RFKGKEIGEGMVFDANSHYPAQMYVRPLPYGTPLFYEGEYKENIDHPLYIQNLKVRFR
LKERHIPCIQVKQSSLFIQNEYLESSVNKLGVDELIELTLTNVDLDLFFEHYEILEIH
YTYGYMFRASCDMFKDFIDKWTYIKTTSYGAIKQLAKLMLNSLYGKFASNPDVTGKVP
YLKENGALGFRLGEEETKDPVYTPLASFVTAWGRYTTITTAQACYDRIIYCDTDSIHL
TGTEIPDVIKDIVDPKKLGYWEHESTFKRAKYLRQKTYIQDIYMKRVKGYLVQGSPDD
YTDIKFSVKCAGMTDKIKEEVTFENFKVGFSRKMKPKPVQVPGGVVLVDETFTIK |
| C0139 | 235 | MSRKMFSCDFETTTKLDDCRVWAYGYMEIGNLDNYKIGNSLDEFMQWVMEIQADLYFH
DLKFDGAFIINWLERNGFKWSADGLPNTYNTIISRMGQWYMIDICLGYKGKRKIHTVI
YDSLKKLPFPVEKIAKDFKLTVKKGDIDIHKERPVGYKITPEEYAYIKNDIQIIAEAL
LIQFKQGLDRMTAGSDSLKDFKDIITTKKFKKVFPTLSLGLDKEVRKAYRGGFTWLND
RFKGKEIGEGMVFDANSHYPAQMYVRPLPYGTPLFYEGEYKENIDHPLYIQNLKVRFR
LKERHIPCIQVKQSSLFIQNEYLESSVNKLGVDELIELTLTNVDLDLFFEHYEILEIH
YTYGYMFRASCDMFKDFIDKWTYIKTTSYGAIKQLAKLMLNSLYGKFASNPDVTGKVP
YLKENGALGFRLGEEETKDPVYTPLASFVTAWGRYTTITTAQACYDRIIYCDTDSIHL
TGTKIPDVIKDIVHPKKLGYWEHESTFKRAKYLRQKTYIQDIYMKRVKGYLVQGSPDD
YTDIKFSVKCAGMTDKIKEEVTFENFKVGFSRKMKPKPVQVPGGVVLVDSVFTIK |
| C0140 | 236 | MSRKRFSCDFETTTKLDDCRVWAYGYMEIGNLDNYKIGNSLDEFMQWAMEIQADLYFH
DLKFDGAFIINWLERNGFKWSADGLPNTYNTIISRMGQWYMIDICLGYKGKRKIHTVI
YDSLKKLPFPVEKIAKDFKLTVKKGDIDIHKERPVGYKITPEEYAYIKNDIQIIAEAL
LIQFKQGLDRMTAGSDSLKDFKDIITTKKFKKVFPTLSLGLDKEVRKAYRGGFTWLND
RFKGKEIGEGMVFDANSHYPAQMYVRPLPYGTPLFYEGEYKENIDHPLYIQNLKVRFR
LKERHIPCIQVKQSSLFIQNEYLESSVNKLGVDELIELTLTNVDLDLFFEHYEILEIH
YTYGYMFRASCDMFKDFIDKWTYIKTTSYGAIKQLAKLMLNSLYGKFASNPDVTGKVP
YLKENGALGFRLGEEETKDPVYTPLASFVTAWGRYTTITTAQACYDRIIYCDTDSIHL
TGTKIPDVIKDIVHPKKLGYWEHESTFKRAKYLRQKTYIQDIYMKRVKGYLVQGSPDD
YTDIKFSVKCAGMTDKIKEEVTFENFKVGFSRKMKPKPVQVPGGVVLVDSVFTIK |
| C0141 | 237 | MSRKMFSCDFETTTKLDDCRVWAYGYMEIGNLDNYKIGNSLDEFMQWVMEIQADLYFH
DLKFDGAFIINWLFKNGFKWCKEAKEERTFSTIISRMGQWYMIDICLGYKGKRKIHTV
IYDSLKKLPFPVEKIADFKLTVKKGDIDIHKERPVGYKITPEEYAYIKNDIQIIAEA
LLIQFKQGLDRMTAGSDSLKGFKDIITTKKFKKVFPTLSLGLDKEVRKAYRGGFTWLN
DRFKGKEIGEGMVFDANSHYPAQMYVRPLPYGTPLFYEGEYKENIDYPLYIQNIKVRF
RLKERHIPTIQVKQSSLFIQNEYLESSVNKLGVDELIDLTLTNVDLDLFFEHYDILEI
HYTYGYMFKASCDMFKDFIDKWTYIKTTSYGAIKQLAKLMLNSLYGKFASNPDVTGKV
PYLKENGALGFRLGEEETKDPVYTPLASFVTAWGRYTTITTAQACYDRIIYCDTDSIH
LTGTEIPDVIKDIVDPKKLGYWEHESTFKRAKYLRQKTYIQDIYMKRVKGYLVQGSPD
DYTDIKFSVKCAGMTDKIKKEVTFENFKVGFSRKMKPKPVQVPGGVVLVDETFTIK |
| C0142 | 238 | MSRKMFSCDFETTTKLDDCRVWAYGYMEIGNLDNYKIGNSLDEFMQWVMEIQADLYFH
DLKFDGAFIINWLFKNGFKWCKEAKEERTFSTIISRMGQWYMIDICLGYKGKRKIHTV
IYDSLKKLPFPVEKIAKDFKLTVKKGDIDIHKERPVGYKITPEEYAYIKNDIQIIAEA
LLIQFKQGLDRMTAGSDSLKGFKDIITTKKFKKVFPTLSLGLDKEVRKAYRGGFTWLN
DRFKGKEIGEGMVFDANSHYPAQMYVRPLPYGTPLFYEGEYKENIDHPLYIQNLKVRF
RLKERHIPCIQVKQSSLFIQNEYLESSVNKLGVDELIELTLTNVDLDLFFEHYEILEI
HYTYGYMFRASCDMFKDFIDKWTYIKTTSYGAIKQLAKLMLNSLYGKFASNPDVTGKV
PYLKENGALGFRLGEEETKDPVYTPMGVFITAWGRYTTITAAQACYDRIIYCDTDSIH |

TABLE 3-continued

Chimeric Polymerase Variants

| Name | SEQ ID NO | Sequence |
|---|---|---|
| | | LTGTEIPDVIKDIVDPKKLGYWEHESTFKRAKYLRQKTYIQDIYMKRVKGYLVQGSPD<br>DYTDIKFSVKCAGMTDKIKKEVTFENFKVGFSRKMKPKPVQVPGGVVLVDETFTIK |
| C0143 | 239 | MSRKRFSCDFETTTKLDDCRVWAYGYMEIGNLDNYKIGNSLDEFMQWAMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDANSHYPAQMYVRPLPYGTPLFYEGEYKENIQHPLYIQNLKVRFR<br>LKERHIPCIQVKQSSLFIQNEYLESSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPLASFVTAWGRFTTITTAQACYDRIIYCDTDSIHL<br>TGTKIPDVIKDIVHPKKLGYWEHESTFKRAKYLRQKTYIQDIYMKRVKGYLVQGSPDD<br>YTDIKFSVKCAGMTDKIKEEVTFDNFKVGFSRKMKPKPVQVPGGVVLVDSVFTIK |
| C0144 | 240 | MSRKMFSCDFETTTKLDDCRVWAYGYMEIGNLDNYKIGNSLDEFMQWVMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKGFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTEIPDVIKDIVDPKKLGYWEHESTFKRAKYLRQKTYIQDIYMKRVKGYLVQGSPD<br>DYTDIKFSVKCAGMTDKIKKEVTFENFKVGFSRKMKPKPVQVPGGVVLVDETFTIK |
| C0145 | 241 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0146 | 242 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIQHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRFTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFDNFKVGFSRKMKPKPVQVPGGVVLVDSVFTIK |
| C0147 | 243 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAQDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSHYPAQMYVRPLPYGTPLFYEGEYKENIQHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRFTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFDNFKVGFSRKMKPKPVQVPGGVVLVDSVFTIK |
| C0148 | 244 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAQDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSHYPAQMYVRPLPYGTPLFYQGEYKENIQHPLYIQNLKVRF<br>RLKERHIPCIQVKQNSLFIQNEYLENSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRFTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFDNFKVGFSRKMKPKPVQVPGGVVLVDSVFTIK |
| C0149 | 245 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIQHPLYIQNLKVRF<br>RLKERHIPCIQVKQNSLFIQNEYLENSVNKLGVDELIELTLTNVDLDLFFEHYEILEI |

TABLE 3-continued

Chimeric Polymerase Variants

| Name | SEQ ID NO | Sequence |
|---|---|---|
| | | HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRFTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFDNFKVGFSRKMKPKPVQVPGGVVLVDSVFTIK |
| C0150 | 246 | MSRKRFSCDFETTTKLDDCRVWAYGYMEVGNLDNYKIGNSIDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIQHPLYIQNLKVRF<br>RLKERHIPCIQVKQNSLFIQNEYLENSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRFTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFDNFKVGFSRKMKPKPVQVPGGVVLVDSVFTIK |
| C0151 | 247 | MHKMSKKMFSCDFETTTKLDDCRVWAYGYMEVGNLDNYKIGNNIDEFMQWIMEIQADL<br>YFHDLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C0152 | 248 | MHKMSRKMFSCDFETTTKLDDCRVWAYGYMEVGNLDNYKIGNSIDEFMQWVMEIQADL<br>YFHDLKFDGAFIINWLERNGFKWSADGLPNTYNTIISRMGQWYMIDICLGYKGKRKIH<br>TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C0153 | 249 | MSKKMFSCDFETTTKLDDCRVWAYGYMEVGNLDNYKIGNNIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0154 | 250 | MSRKMFSCDFETTTKLDDCRVWAYGYMEVGNLDNYKIGNNIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0155 | 251 | MSRKMFSCDFETTTKLDDCRVWAYGYMELGNLDNYKIGNNIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0156 | 252 | MSRKMFSCDFETTTKLDDCRVWAYGYMELGNLDNYKIGNTIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND |

TABLE 3-continued

Chimeric Polymerase Variants

| Name | SEQ ID NO | Sequence |
|---|---|---|
| | | RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0157 | 253 | MSRKMFSCDFETTTKLDDCRVWAYGYMEVGNLDNYKIGNTIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0158 | 254 | MSRKMFSCDFETTTKLDDCRVWAYGYMEIGNLDNYKIGNNIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0159 | 255 | MSRKMFSCDFETTTKLDDCRVWAYGYMEIGNLDNYKIGNTIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0160 | 256 | MSRKMFSCDFETTTKLDDCRVWAYGYMEVGNLDNYKIGNTLDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0161 | 257 | MSRKMFSCDFETTTKLDDCRVWAYGYMEVGNLDNYKIGNSIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0162 | 258 | MSRKMFSCDFETTTKLDDCRVWAYGYMELGNLDNYKIGNSIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0163 | 259 | MHKMSRKRFSCDFETTTKLDDCRVWAYGYMEVGNLDNYKIGNNIDEFMQWAMEIQADL<br>YFHDLKFDGAFIINWLERNGFKWSADGLPNTYNTIISRMGQWYMIDICLGYKGKRKIH |

TABLE 3-continued

Chimeric Polymerase Variants

| Name | SEQ ID NO | Sequence |
|---|---|---|
| | | TVIYDSLKKLPFPVEKIAKDFKLTVKKGDIDIHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDANSHYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTEIPDVIKDIVDPKKLGYWEHESTFKRAKYLRQKTYIQDIYMKRVKGYLVQGS<br>PDDYTDIKFSVKCAGMTDKIKKEVTFENFKVGFSRKMKPKPVQVPGGVVLVDETFTIK |
| C0164 | 260 | MSRKRFSCDFETTTKLDDCRVWAYGYMEVGNLDNYKIGNNIDEFMQWAMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0165 | 261 | MSRKRFSCDFETTTKLDDCRVWAYGYMEVGNLDNYKIGNNIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0166 | 262 | MSRKRFSCDFETTTKLDDCRVWAYGYMEVGNLDNYKIGNTIDEFMQWIMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0167 | 263 | MSRKMFSCDFETTTKLDDCRVWAYGYMEVGNLDNYKIGNNIDEFMQWAMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0168 | 264 | MSRKRFSCDFETTTKLDDCRVWAYGYMEIGNLDNYKIGNSLDEFMQWAMEIQADLYFH<br>DLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVR<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0169 | 265 | MHKMSRKRFSCDFETTTKLDDCRVWAYGYMEVGNLDNYKIGNNIDEFMQWAMEIQADL<br>YFHDLKFDGAFIINWLFKNGPKWCKEAKEERTFSTIISRMGQWYMIDICLGYKGKRKI<br>HTVIYDSLKKLPFPVEKIAKDFKLTVKKGDIDIHKERPVGYKITPEEYAYIKNDIQII<br>AEALLIQFKQGLDRMTAGSDSLKDFKDIITTKKFKKVFPTLSLGLDKEVRKAYRGGFT<br>WLNDRFKGKEIGEGMVFDANSHYPAQMYVRPLPYGTPLFYEGEYKENIDHPLYIQNLK<br>VRFRLKERHIPCIQVKQSSLFIQNEYLESSVNKLGVDELIELTLTNVDLDLFFEHYEI<br>LEIHYTYGYMFRASCDMFKDFIDKWTYIKTTSYGAIKQLAKLMLNSLYGKFASNPDVT<br>GKVPYLKENGALGFRLGEEETKDPVYTPLASFVTAWGRYTTITTAQACYDRIIYCDTD<br>SIHLTGTKIPDVIKDIVHPKKLGYWEHESTFKRAKYLRQKTYIQDIYMKRVKGYLVQG<br>SPDDYTDIKFSVKCAGMTDKIKEEVTFENFKVGFSRKMKPKPVQVPGGVVLVDSVFTI<br>K |

TABLE 3-continued

Chimeric Polymerase Variants

| Name | SEQ ID NO | Sequence |
|---|---|---|
| C0170 | 266 | MHKMSRKRFSCDFETTTKLDDCRVWAYGYMEVGNLDNYKIGNNIDEFMQWAMEIQADL YFHDLKFDGAFIVNWLFKNGFKWCKEAKEERTFSTIISRMGQWYMIDICIGYKGKRKI HTVIYDSLKKLPFPVEKIAKDFKLTVKKGDIDIHKERPVGYKITPEEYAYIKNDIQII AEALLIQFKQGLDRMTAGSDSLKDFKDIITTKKFKKVFPTLSLGLDKEVRKAYRGGFT WLNDRFKGKEIGEGMVFDANSHYPAQMYVRPLPYGTPLFYEGEYKENIDHPLYIQNLK VRFRLKERHIPCIQVKQSSLFIQNEYLESSVNKLGVDELIELTLTNVDLDLFFEHYEI LEIHYTYGYMFRASCDMFKDFIDKWTYIKTTSYGAIKQLAKLMLNSLYGKFASNPDVT GKVPYLKENGALGFRLGEEETKDPVYTPLASFVTAWGRYTTITTAQACYDRIIYCDTD SIHLTGTKIPDVIKDIVHPKKLGYWEHESTFKRAKYLRQKTYIQDIYMKRVKGYLVQG SPDDYTDIKFSVKCAGMTDKIKEEVTFENFKVGFSRKMKPKPVQVPGGVVLVDSVFTI K |
| C0171 | 267 | MHKMSRKRFSCDFETTTKLDDCRVWAYGYMEVGNLDNYKIGNNIDEFMQWAMEIQADL YFHDLKFDGAFIVNWLFKNGFKWCKEAKEERTFSTIISRMGQWYMIDICIGYKGKRKI HTVIYDSLKKLPFPVEKIAKDFKLTVKKGDIDIHKERPVGYKITPEEYAYIKNDIQII AEALLIQFKQGLDRMTAGSDSLKDFKDIITTKKFKKVFPTLSLGLDKEVRKAYRGGFT WLNDRFKGKEIGEGMVFDANSHYPAQMYVRPLPYGTPLFYQGEYKENIDHPLYIQNLK VRFRLKERHIPCIQVKQSSLFIQNEYLESSVNKLGVDELIELTLTNVDLDLFFEHYEI LEIHYTYGYMFRASCDMFKDFIDKWTYIKTTSYGAIKQLAKLMLNSLYGKFASNPDVT GKVPYLKENGALGFRLGEEETKDPVYTPLASFVTAWGRYTTITTAQACYDRIIYCDTD SIHLTGTKIPDVIKDIVHPKKLGYWEHESTFKRAKYLRQKTYIQDIYMKRVKGYLVQG SPDDYTDIKFSVKCAGMTDKIKEEVTFENFKVGFSRKMKPKPVQVPGGVVLVDSVFTI K |
| C0172 | 268 | MHKMSRKRFSCDFETTTKLDDCRVWAYGYMEVGNLDNYKIGNNIDEFMQWAMEIQADL YFHDLKFDGAFIVNWLFKNGFKWCKEAKEERTFSTIISRMGQWYMIDICIGYKGKRKI HTVIYDSLKKLPFPVEKIAKDFKLTVKKGDIDIHKERPVGYKITPEEYAYIKNDIQII AEALLIQFKQGLDRMTAGSDSLKDFKDIITTKKFKKVFPTLSLGLDKEVRKAYRGGFT WLNDRFKGKEIGEGMVFDANSHYPAQMYVRPLPYGTPLFYQGEYKENIDHPLYIQNLK VRFRLKERHIPCIQVKQSSLFIQNEYLESSVNKLGVDELIELTLTNVDLDLFFEHYEI LEIHYTYGYMFRASCDMFKDFIDKWTYIKTTSYGAIKQLAKLMLNSLYGKFASNPDVT GKVPYLKENGALGFRLGEEETKDPVYTPLASFVTAWGRYTTITTAQACYDRIIYCDTD SIHLTGTKIPDVIKDIVHPKKLGYWEHESTFKRAKYLRQKTYIQDIYMKRVKGYLVQG SPDDYTDIKFSVKCAGMTDKIKEEVTFENFKVGFSRKMKPKPVQVPGGVVLVDSVFTI K |
| C0173 | 269 | MSRKRFSCDFETTTKLDDCRVWAYGYMEIGNLDNYKIGNSLDEFMQWAMEIQADLYFH DLKFDGAFIVNWLFKNGFKWCKEAKEERTFSTIISRMGQWYMIDICIGYKGKRKIHTV IYDSLKKLPFPVEKIAKDFKLTVKKGDIDIHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDANSHYPAQMYVRPLPYGTPLFYQGEYKENIDHPLYIQNLKVRF RLKERHIPCIQVKQNSLFIQNEYLESSVNKLGVDELIELTLTNVDLDLFFEHYEILEI HYTYGYMFRASCDMFKDFIDKWTYIKTTSYGAIKQLAKLMLNSLYGKFASNPDVTGKV PYLKENGALGFRLGEEETKDPVYTPLASFVTAWGRYTTITTAQACYDRIIYCDTDSIH LTGTKIPDVIKDIVHPKKLGYWEHESTFKRAKYLRQKTYIQDIYMKRVKGYLVQGSPD DYTDIKFSVKCAGMTDKIKEEVTFENFKVGFSRKMKPKPVQVPGGVVLVDSVFTIK |
| C0174 | 270 | MHKMSKKMFSCDFETTTKLDDCRVWAYGYMEVGNLDNYKIGNNIDEFMQWIMEIQADL YFHDLKFDGAFIINWLFKNGFKWCKEAKEERTFSTIISRMGQWYMIDICLGYKGKRKI HTVIYDSLKKLPFPVEKIAKDFKLTVKKGDIDIHKERPVGYKITPEEYAYIKNDIQII AEALLIQFKQGLDRMTAGSDSLKDFKDIITTKKFKKVFPTLSLGLDKEVRKAYRGGFT WLNDRFKGKEIGEGMVFDANSHYPAQMYVRPLPYGTPLFYEGEYKENIDHPLYIQNLK VRFRLKERHIPCIQVKQSSLFIQNEYLESSVNKLGVDELIELTLTNVDLDLFFEHYEI LEIHYTYGYMFRASCDMFKDFIDKWTYIKTTSYGAIKQLAKLMLNSLYGKFASNPDVT GKVPYLKENGALGFRLGEEETKDPVYTPLASFVTAWGRYTTITTAQACYDRIIYCDTD SIHLTGTKIPDVIKDIVHPKKLGYWEHESTFKRAKYLRQKTYIQDIYMKRVKGYLVQG SPDDYTDIKFSVKCAGMTDKIKEEVTFENFKVGFSRKMKPKPVQVPGGVVLVDSVFTI K |
| C0175 | 271 | MSRKRFSCDFETTTKLDDCRVWAYGYMEIGNLDNYKIGNSLDEFMQWAMEIQADLYFF HDLKFDGAFIVNWLFKNGFKWCKEAKEERTFSTIISRMGQWYMIDICIGYKGKRKIHT VIYDSLKKLPFPVEKIAKDFKLTVKKGDIDIHKERPVGYKITPEEYAYIKNDIQIIAE ALLIQFKQGLDRMTAGSDSLKDFKDIITTKKFKKVFPTLSLGLDKEVRKAYRGGFTWL NDRFKGKEIGEGMVFDANSHYPAQMYVRPLPYGTPLFYQGEYKENIDHPLYIQNLKVR FRLKERHIPCIQVKQNSLFIQNEYLESSVNKLGVDELIELTLTNVDLDLFFEHYEILE IHYTYGYMFRASCDMFKDFIDKWTYIKTTSYGAIKQLAKLMLNSLYGKFASNPDVTGK VPYLKENGALGFRLGEEETKDPVYTPLASFVTAWGRYTTITTAQACYDRIIYCDTDSI HLTGTKVPDIIKDLVHPKKLGYWEHESTFKRAKYLRQKTYIQDIYMKRVKGYLVQGSP DDYTDIKFSVKCAGMTDKIKEEVTFENFKVGFSRKMKPKPVQVPGGVVLVDSVFTIK |
| C0176 | 272 | MSRKRFSCDFETTTKLDDCRVWAYGYMEIGNLDNYKIGNSLDEFMQWAMEIQADLYFF HDLKFDGAFIVNWLFKNGFKWCKEAKEERTFSTIISRMGQWYMIDICIGYKGKRKIHT VIYDSLKKLPFPVEKIAKDFKLTVKKGDIDIHKERPVGYKITPEEYAYIKNDIQIIAE ALLIQFKQGLDRMTAGSDSLKDFKDIITTKKFKKVFPTLSLGLDKEVRKAYRGGFTWL NDRFKGKEIGEGMVFDANSHYPAQMYVRPLPYGTPLFYQGEYKENIDHPLYIQNLKVR |

TABLE 3-continued

Chimeric Polymerase Variants

| Name | SEQ ID NO | Sequence |
|---|---|---|
| | | FRLKERHIPCIQVKQNSLFIQNEYLESSVNKLGVDELIELTLTNVDLDLFFEHYEILE<br>IHYTYGYMFRASCDMFKDFIDKWTYIKTTSYGAIKQLAKLMLNSLYGKFASNPDVTGK<br>VPYLKENGALGFRLGEEETKDPVYTPLASFVTAWGRYTTITTAQACYDRIIYCDTDSI<br>HLTGTKVPDAIKDLVHPKKLGYWEHESTFKRAKYLRQKTYIQMKRVKGYLVQGSP<br>DDYTDIKFSVKCAGMTDKIKEEVTFENFKVGFSRKMKPKPVQVPGGVVLVDSVFTIK |
| C0177 | 273 | MSRKRFSCDFETTTKLDDCRVWAYGYMEIGNLDNYKIGNSLDEFMQWAMEIQADLYFF<br>HDLKFDGAFIVNWLFKNGFKWCKEAKEERTFSTIISRMGQWYMIDICIGYKGKRKIHT<br>VIYDSLKKLPFPVEKIAKDFKLTVKKGDIDIHKERPVGYKITPEEYAYIKNDIQIIAE<br>ALLIQFKQGLDRMTAGSDSLKDFKDIITTKKFKKVFPTLSLGLDKEVRKAYRGGFTWL<br>NDRFKGKEIGEGMVFDANSHYPAQMYVRPLPYGTPLFYQGEYKENIDHPLYIQNLKVR<br>FRLKERHIPCIQVKQNSLFIQNEYLESSVNKLGVDELIELTLTNVDLDLFFEHYEILE<br>IHYTYGYMFRASCDMFKDFIDKWTYIKTTSYGAIKQLAKLMLNSLYGKFASNPDVTGK<br>VPYLKENGALGFRLGEEETKDPVYTPLASFVTAWGRYTTITTAQACYDRIIYCDTDSI<br>HLTGTKVPDAIKDLVHPKKLGYWEHESTFKRAKYLRQKTYVQDIYMKRVKGYLVQGSP<br>DDYTDIKFSVKCAGMTDKIKEEVTFENFKVGFSRKMKPKPVQVPGGVVLVDSVFTIK |
| C0178 | 274 | MSRKRFSCDFETTTKLDDCRVWAYGYMEIGNLDNYKIGNSLDEFMQWAMEIQADLYFF<br>HDLKFDGAFIVNWLFKNGFKWCKEAKEERTFSTIISRMGQWYMIDICIGYKGKRKIHT<br>VIYDSLKKLPFPVEKIAKDFKLTVKKGDIDIHKERPVGYKITPEEYAYIKNDIQIIAE<br>ALLIQFKQGLDRMTAGSDSLKDFKDIITTKKFKKVFPTLSLGLDKEVRKAYRGGFTWL<br>NDRFKGKEIGEGMVFDANSHYPAQMYVRPLPYGTPLFYQGEYKENIDHPLYIQNLKVR<br>FRLKERHIPCIQVKQNSLFIQNEYLESSVNKLGVDELIELTLTNVDLDLFFEHYEILE<br>IHYTYGYMFRASCDMFKDFIDKWTYIKTTSYGAIKQLAKLMLNSLYGKFASNPDVTGK<br>VPYLKENGALGFRLGEEETKDPVYTPLASFVTAWGRYTTITTAQACYDRIIYCDTDSI<br>HLTGTKVPDIIKDIVHPKKLGYWEHESTFKRAKYLRQKTYIQDIYMKRVKGYLVQGSP<br>DDYTDTKFSVKCAGMTDKIKEEVTFENFKVGFSRKMKPKPVQVPGGVVLVDSVFTIK |
| C0179 | 275 | MSRKRFSCDFETTTKLDDCRVWAYGYMEIGNLDNYKIGNSLDEFMQWAMEIQADLYFF<br>HDLKFDGAFIVNWLFKNGFKWCKEAKEERTFSTIISRMGQWYMIDICIGYKGKRKIHT<br>VIYDSLKKLPFPVEKIAKDFKLTVKKGDIDIHKERPVGYKITPEEYAYIKNDIQIIAE<br>ALLIQFKQGLDRMTAGSDSLKDFKDIITTKKFKKVFPTLSLGLDKEVRKAYRGGFTWL<br>NDRFKGKEIGEGMVFDANSHYPAQMYVRPLPYGTPLFYQGEYKENIDHPLYIQNLKVR<br>FRLKERHIPCIQVKQNSLFIQNEYLESSVNKLGVDELIELTLTNVDLDLFFEHYEILE<br>IHYTYGYMFRASCDMFKDFIDKWTYIKTTSYGAIKQLAKLMLNSLYGKFASNPDVTGK<br>VPYLKENGALGFRLGEEETKDPVYTPLASFVTAWGRYTTITTAQACYDRIIYCDTDSI<br>HLTGTKVPDAIKDIVHPKKLGYWEHESTFKRAKYLRQKTYIQDIYMKRVKGYLVQGSP<br>DDYTDGKFSVKCAGMTDKIKEEVTFENFKVGFSRKMKPKPVQVPGGVVLVDSVFTIK |
| C0180 | 276 | MSRKRFSCDFETTTKLDDCRVWAYGYMEIGNLDNYKIGNSLDEFMQWAMEIQADLYFF<br>HDLKFDGAFIVNWLFKNGFKWCKEAKEERTFSTIISRMGQWYMIDICIGYKGKRKIHT<br>VIYDSLKKLPFPVEKIAKDFKLTVKKGDIDIHKERPVGYKITPEEYAYIKNDIQIIAE<br>ALLIQFKQGLDRMTAGSDSLKDFKDIITTKKFKKVFPTLSLGLDKEVRKAYRGGFTWL<br>NDRFKGKEIGEGMVFDANSHYPAQMYVRPLPYGTPLFYQGEYKENIDHPLYIQNLKVR<br>FRLKERHIPCIQVKQNSLFIQNEYLESSVNKLGVDELIELTLTNVDLDLFFEHYEILE<br>IHYTYGYMFRASCDMFKDFIDKWTYIKTTSYGAIKQLAKLMLNSLYGKFASNPDVTGK<br>VPYLKENGALGFRLGEEETKDPVYTPLASFVTAWGRYTTITTAQACYDRIIYCDTDSI<br>HLTGTKVPDAIKDIVHPKKLGYWEHESTFKRAKYLRQKTYIQDIYMKRVKGYLVQGSP<br>DDYTDGKFSVKCAGMTDKIKEEVTFENFKVGFSRKMKPKPVQVPGGVVLVDSVFTIK |
| C0181 | 277 | MSRKRFSCDFETTTKLDDCRVWAYGYMEIGNLDNYKIGNSLDEFMQWAMEIQADLYFF<br>HDLKFDGAFIVNWLFKNGFKWCKEAKEERTFSTIISRMGQWYMIDICIGYKGKRKIHT<br>VIYDSLKKLPFPVEKIAKDFKLTVKKGDIDIHKERPVGYKITPEEYAYIKNDIQIIAE<br>ALLIQFKQGLDRMTAGSDSLKDFKDIITTKKFKKVFPTLSLGLDKEVRKAYRGGFTWL<br>NDRFKGKEIGEGMVFDANSHYPAQMYVRPLPYGTPLFYQGEYKENIDHPLYVQNLKVR<br>FRLKERHIPCIQVKQNSLFIQNEYLESSVNKLGVDELIEITLTNVDVDLFFEHYEILE<br>IHYTYGYMFRASCDMFKDFIDKWTYIKTTSYGAIKQLAKLMLNSLYGKFASNPDVTGK<br>VPYLKENGALGFRLGEEETKDPVYTPLASFVTAWGRYTTITTAQACYDRIIYCDTDSI<br>HLTGTKIPDVIKDIVHPKKLGYWEHESTFKRAKYLRQKTYIQDIYMKRVKGYLVQGSP<br>DDYTDIKFSVKCAGMTDKIKEEVTFENFKVGFSRKMKPKPVQVPGGVVLVDSVFTIK |
| C0182 | 278 | MSRKRFSCDFETTTKLDDCRVWAYGYMEIGNLDNYKIGNSLDEFMQWAMEIQADLYFF<br>HDLKFDGAFIVNWLFKNGFKWCKEAKEERTFSTIISRMGQWYMIDICIGYKGKRKLHT<br>VIYDSLKKLPFPVEKIAKDFKLTVKKGDIDIHKERPVGYKITPEEYAYIKNDIQIIAE<br>ALLIQFKQGLDRMTAGSDSLKDFKDIITTKKFKKVFPTLSLGLDKEVRKAYRGGFTWL<br>NDRFKGKEIGEGMVFDANSHYPAQMYVRPLPYGTPLFYQGEYKENIDHPLYVQNLKVR<br>FRLKERHIPCIQVKQNSLFIQNEYLESSVNKLGVDELIEITLTNVDLDLFFEHYEILE<br>IHYTYGYMFRASCDMFKDFIDKWTYIKTTSYGAIKQLAKLMLNSLYGKFASNPDVTGK<br>VPYLKENGALGFRLGEEETKDPVYTPLASFVTAWGRYTTITTAQACYDRIIYCDTDSI<br>HLTGTKIPDVIKDIVHPKKLGYWEHESTFKRAKYLRQKTYIQDIYMKRVKGYLVQGSP<br>DDYTDIKFSVKCAGMTDKIKEEVTFENFKVGFSRKMKPKPVQVPGGVVLVDSVFTIK |
| C0183 | 279 | MSRKRFSCDFETTTKLDDCRVWAYGYMEIGNLDNYKIGNSLDEFMQWAMEIQADLYFF<br>HDLKFDGAFIVNWLFKNGFKWCKEAKEERTFSTIISRMGQWYMIDICIGYKGKRKQHT<br>VIYDSLKKLPFPVEKIAKDFKLTVKKGDIDIHKERPVGYKITPEEYAYIKNDIQIIAE |

TABLE 3-continued

Chimeric Polymerase Variants

| Name | SEQ ID NO | Sequence |
|---|---|---|
| | | ALLIQFKQGLDRMTAGSDSLKDFKDIITTKKFKKVFPTLSLGLDKEVRKAYRGGFTWL<br>NDRFKGKEIGEGMVFDANSHYPAQMYVRPLPYGTPLFYQGEYKENIDHPLYVQNLKVR<br>FRLKERHIPCIQVKQNSLFIQNEYLESSVNKLGVDELIEITLTNVDVDLFFEHYEILE<br>IHYTYGYMFRASCDMFKDFIDKWTYIKTTSYGAIKQLAKLMLNSLYGKFASNPDVTGK<br>VPYLKENGALGFRLGEEETKDPVYTPLASFVTAWGRYTTITTAQACYDRIIYCDTDSI<br>HLTGTKIPDVIKDIVHPKKLGYWEHESTFKRAKYLRQKTYIQDIYMKRVKGYLVQGSP<br>DDYTDIKFSVKCAGMTDKIKEEVTFENFKVGFSRKMKPKPVQVPGGVVLVDSVFTIK |
| C0184 | 280 | MSRKRFSCDFETTTKLDDCRVWAYGYMEIGNLDNYKIGNSLDEFMQWAMEIQADLYFF<br>HDLKFDGAFIVNWLFKNGFKWCKEAKEERTFSTIISRMGQWYMIDICIGYKGKRKIHT<br>VIYDSLKKLPFPVEKIAKDFKLTVKKGDIDIHKERPVGYKITPEEYAYIKNDIQIIAE<br>ALLIQFKQGLDRMTAGSDSLKDFKDIITTKKFKKVFPTLSLGLDKEVRKAYRGGFTWL<br>NDRFKGKEIGEGMVFDANSHYPAQMYVRPLPYGTPLFYQGEYKENIDHPLYIQNLKVR<br>FRLKERHIPCIQVKQNSLFIQNEYLESSVNKLGVDELIELTVTNVDLDLFFEHYEILE<br>IHYTYGYMFRGSCDMFKDFIDKWTYIKTTSYGAIKQLAKLMLNSLYGKFASNPDVTGK<br>VPYLKENGALGFRLGEEETKDPVYTPLASFVTAWGRYTTITTAQACYDRIIYCDTDSI<br>HLTGTKVPDVIKDIVHPKKLGYWEHESTFKRAKYLRQKTYIQDIYMKRVKGYLVQGSP<br>DDYTDIKFSVKCAGMTDKIKEEVTFENFKVGFSRKMKPKPVQVPGGVVLVDSVFTIK |
| C0185 | 281 | MSRKRFSCDFETTTKLDDCRVWAYGYMEIGNLDNYKIGNSLDEFMQWAMEIQADLYFF<br>HDLKFDGAFIVNWLFKNGFKWCKEAKEERTFSTIISRMGQWYMIDICIGYKGKRKIHT<br>VIYDSLKKLPFPVEKIAKDFKLTVKKGDIDIHKERPVGYKITPEEYAYIKNDIQIIAE<br>ALLIQFKQGLDRMTAGSDSLKDFKDIITTKKFKKVFPTLSLGLDKEVRKAYRGGFTWL<br>NDRFKGKEIGEGMVFDANSHYPAQMYVRPLPYGTPLFYQGEYKENIDHPLYIQNLKVR<br>FRLKERHIPCIQVKQNSLFIQNEYLESSVNKLGVDELIELTVTNVDLDLFFEHYEILE<br>IHYTYGYMFRSSCDMFKDFIDKWTYIKTTSYGAIKQLAKLMLNSLYGKFASNPDVTGK<br>VPYLKENGALGFRLGEEETKDPVYTPLASFVTAWGRYTTITTAQACYDRIIYCDTDSI<br>HLTGTKVPDVIKDIVHPKKLGYWEHESTFKRAKYLRQKTYIQDIYMKRVKGYLVQGSP<br>DDYTDIKFSVKCAGMTDKIKEEVTFENFKVGFSRKMKPKPVQVPGGVVLVDSVFTIK |
| C0186 | 282 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0187 | 283 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0188 | 284 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0189 | 285 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWFYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |

TABLE 3-continued

Chimeric Polymerase Variants

| Name | SEQ ID NO | Sequence |
|---|---|---|
| C0190 | 286 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0191 | 287 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDIIKDLVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0192 | 288 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDAIKDLVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0193 | 289 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDAIKDLVHPKKLGYWEHESTFKRAKYLRQKTYVQDIYMKRVKGYLVQGSPD<br>DYTDIKFSVKCAGMTDKIKEEVTFENFKVGFSRKMKPKPVQVPGGVVLVDSVFTIK |
| C0194 | 290 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDIIKDIVHPKKLGYWEHESTFKRAKYLRQKTYIQDIYMKRVKGYLVQGSPD<br>DYTDTKFSVKCAGMTDKIKEEVTFENFKVGFSRKMKPKPVQVPGGVVLVDSVFTIK |
| C0195 | 291 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDAIKDIVHPKKLGYWEHESTFKRAKYLRQKTYIQDIYMKRVKGYLVQGSPD<br>DYTDGKFSVKCAGMTDKIKEEVTFENFKVGFSRKMKPKPVQVPGGVVLVDSVFTIK |
| C0196 | 292 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH |

TABLE 3-continued

Chimeric Polymerase Variants

| Name | SEQ ID NO | Sequence |
|---|---|---|
| | | LTGTKVPDAIKDLVHPKKLGYWEHESTFKRAKYLRQKTYIQDIYMKRVKGYLVQGSPD<br>DYTDGKFSVKCAGMTDKIKEEVTFENFKVGFSRKMKPKPVQVPGGVVLVDSVFTIK |
| C0197 | 293 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKLHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYVQNLKVRF<br>RLKERHIPCIQVKQNSLFIQNEYLESSVNKLGVDELIEITLTNVDVDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0198 | 294 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYVQNLKVRF<br>RLKERHIPCIQVKQNSLFIQNEYLESSVNKLGVDELIEITLTNVDVDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0199 | 295 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKQHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYVQNLKVRF<br>RLKERHIPCIQVKQNSLFIQNEYLESSVNKLGVDELIEITLTNVDVDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0200 | 296 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTVTNVDLDLFFEHYEILEI<br>HYTYGYMFRGSCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0201 | 297 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTVTNVDLDLFFEHYEILEI<br>HYTYGYMFRSSCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0202 | 298 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDIIKDLVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0203 | 299 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI |

TABLE 3-continued

Chimeric Polymerase Variants

| Name | SEQ ID NO | Sequence |
|---|---|---|
| | | HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDAIKDLVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0204 | 300 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYSRLLPYGEPIVFEGKYVWDEDYPLHIQRICEF<br>ELKEGYIPTIQIKRSRFYKGNEYLKSSGGEIADLWLSNVDLELMKEHYDLYNVEYISG<br>LKFKATTGLFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0205 | 301 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDVNSMYPAMMKNKLLPYGEPVMFKGEYKKNVEYPLYIQQVRCFF<br>ELKKDKIPCIQIKGNARFGQNEYLSTSGDEYVDLYVTNVDWELIKKHYDIFEEEFIGG<br>FMFKGFIGFFDEYIDRFMEIKNSPDSSAEQSLQAKLMLNSLYGKFASNPDVTGKVPYL<br>KENGALGFRLGEEETKDPVYTPLASFVTAWGRYTTITTAQACYDRIIYCDTDSIHLTG<br>TKIPDVIKDIVHPKKLGYWEHESTFKRAKYLRQKTYIQDIYMKRVKGYLVQGSPDDYT<br>DIKFSVKCAGMTDKIKEEVTFENFKVGFSRKMKPKPVQVPGGVVLVDSVFTIK |
| C0206 | 302 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKKNVEYPLYIQQVRCFF<br>ELKKDKIPCIQIKGNARFGQNEYLSTSGDEYVDLYVTNVDWELIKKHYDIFEEEFIGG<br>FMFKGFIGFFDDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0207 | 303 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYSRPLPYGAPIVFQGKYEKDEQYPLYIQRIRFEF<br>ELKEGYIPTIQIKKNPFFKGNEYLKNSGVEPVELYLTNVDLELIQEHYELYNVEYIDG<br>FKFREKTGLFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0208 | 304 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0209 | 305 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKPNNDYPLYIQNIKVRF<br>RLKEGYIPTIQVKQSSLFIQNEYLDSSVNKLGVDELIDLTLTNVDLELFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0210 | 306 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN |

TABLE 3-continued

Chimeric Polymerase Variants

| Name | SEQ ID NO | Sequence |
|---|---|---|
| | | DRFKGKEIGEGMVFDANSAYPAQMYVRPLPYGTPLFYEGEYKENIDHPLYIQNLKVRF<br>RLKEGYIPTIQIKRSRFYKGNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0211 | 307 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSAYPAQMYVRPLPYGTPLFYEGEYKENIDHPLYIQNLKVRF<br>RLKEGYIPTIQIKRSRFYKGNEYLKSSGGELIELTLTNVDLDLFFEHYEILEIHYTYG<br>YMFRASCDMFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0212 | 308 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSAYPAQMYVRPLPYGTPLFYEGEYKENIDHPLYIQNLKVRF<br>RLKEGYIPTIQIKRSRFYKGNEYLKSSGGELIELTLTNVDLELMKEHYEILEIHYTYG<br>YMFRASCDMFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0213 | 309 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSAYPAQMYVRLLPYGEPLFYEGEYKENIDHPLYIQNLKVRF<br>RLKEGYIPTIQIKRSRFYKGNEYLKSSGGELIELTLTNVDLELMKEHYEILEIHYTYG<br>YMFKATTGMFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0214 | 310 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSAYPAQMYVRLLPYGEPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFKATTGMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0215 | 311 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSAYPAQMYVRLLPYGEPLFYEGEYKENIDHPLYIQNLKVRF<br>RLKEGYIPTIQIKRSRFYKGNEYLKSSGGELIELTLTNVDLDLFFEHYEILEIHYTYG<br>YMFKATTGMFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0216 | 312 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKRSRLFIQNEYLESSVNELIELTLTNVDLDLFFEHYEILEIHYTYG<br>YMFRASCDMFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0217 | 313 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV |

TABLE 3-continued

Chimeric Polymerase Variants

| Name | SEQ ID NO | Sequence |
|---|---|---|
| | | IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKRSRLFKQNEYLESSVNELIELTLTNVDLDLFFEHYEILEIHYTYG<br>YMFRASCDMFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0218 | 314 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKRSRLYKQNEYLESSVNELIELTLTNVDLDLFFEHYEILEIHYTYG<br>YMFRASCDMFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0219 | 315 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKRSRFYKGNEYLESSVNELIELTLTNVDLDLFFEHYEILEIHYTYG<br>YMFRASCDMFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0220 | 316 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKRSRLFKQNEYLESSVNELIELTLTNVDLDLFFEHYEILEIHYTYG<br>YMFRASCDMFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0221 | 317 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGLPVPFSGEYEYDETHPLFIQHIKCGF<br>ELKDGHIPTIQIKKNFRFADNEYLHSSEGNILDLHVTNVDLALIKEHYTLYEEEYLQG<br>YKFKQVTGLFKNYIDYWSDKKINAEDPAIRQMAKLMLNSLYGKFASNPDVTGKVPYLK<br>ENGALGFRLGEEETKDPVYTPLASFVTAWGRYTTITTAQACYDRIIYCDTDSIHLTGT<br>KIPDVIKDIVHPKKLGYWEHESTFKRAKYLRQKTYIQDIYMKRVKGYLVQGSPDDYTD<br>IKFSVKCAGMTDKIKEEVTFENFKVGFSRKMKPKPVQVPGGVVLVDSVFTIK |
| C0222 | 318 | MSRKRFSCDFETTTKLDDCRVWAYGYMEIGNLDNYKIGNSLDEFMQWAMEIQADLYFH<br>DLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSAYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0223 | 319 | MSRKRFSCDFETTTKLDDCRVWAYGYMEIGNLDNYKIGNSLDEFMQWAMEIQADLYFH<br>DLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |

TABLE 3-continued

Chimeric Polymerase Variants

| Name | SEQ ID NO | Sequence |
|---|---|---|
| C0224 | 320 | MSRKRFSCDFETTTKLDDCRVWAYGYMEIGNLDNYKIGNSLDEFMQWAMEIQADLYFH
DLKFDGAFIVNWLFKNGFKWCKEAKEERTFSTIISRMGQWYMIDICIGYKGKRKIHTV
IYDSLKKLPFPVEKIAKDFKLTVKKGDIDIHKERPVGYKITPEEYAYIKNDIQIIAEA
LLIQFKQGLDRMTAGSDSLKDFKDIITTKKFKKVFPTLSLGLDKEVRKAYRGGFTWLN
DRFKGKEIGEGMVFDANSHYPAQMYVRPLPYGTPLFYQGEYKENIDHPLYIQNLKVRF
RLKERHIPCIQVKQNSLFIQNEYLESSVNELIELTLTNVDLDLFFEHYEILEIHYTYG
YMFRASCDMFKDFIDKWTYIKTTSYGAIKQLAKLMLNSLYGKFASNPDVTGKVPYLKE
NGALGFRLGEEETKDPVYTPLASFVTAWGRYTTITTAQACYDRIIYCDTDSIHLTGTK
IPDVIKDIVHPKKLGYWEHESTFKRAKYLRQKTYIQDIYMKRVKGYLVQGSPDDYTDI
KFSVKCAGMTDKIKEEVTFENFKVGFSRKMKPKPVQVPGGVVLVDSVFTIK |
| C0225 | 321 | MSRKRFSCDFETTTKLDDCRVWAYGYMEIGNLDNYKIGNSLDEFMQWAMEIQADLYFH
DLKFDGAFIVNWLFKNGFKWCKEAKEERTFSTIISRMGQWYMIDICIGYKGKRKIHTV
IYDSLKKLPFPVEKIAKDFKLTVKKGDIDIHKERPVGYKITPEEYAYIKNDIQIIAEA
LLIQFKQGLDRMTAGSDSLKDFKDIITTKKFKKVFPTLSLGLDKEVRKAYRGGFTWLN
DRFKGKEIGEGMVFDINSHYPAQMYVRPLPYGTPLFYQGEYKENIDHPLYIQNLKVRF
RLKERHIPCIQVKQNSLFIQNEYLESSVNKLGVDELIELTLTNVDLDLFFEHYEILEI
HYTYGYMFRASCDMFKDFIDKWTYIKTTSYGAIKQLAKLMLNSLYGKFASNPDVTGKV
PYLKENGALGFRLGEEETKDPVYTPLASFVTAWGRYTTITTAQACYDRIIYCDTDSIH
LTGTKIPDVIKDIVHPKKLGYWEHESTFKRAKYLRQKTYIQDIYMKRVKGYLVQGSPD
DYTDIKFSVKCAGMTDKIKEEVTFENFKVGFSRKMKPKPVQVPGGVVLVDSVFTIK |
| C0226 | 322 | MSRKRFSCDFETTTKLDDCRVWAYGYMEIGNLDNYKIGNSLDEFMQWAMEIQADLYFH
DLKFDGAFIVNWLFKNGFKWCKEAKEERTFSTIISRMGQWYMIDICIGYKGKRKIHTV
IYDSLKKLPFPVEKIAKDFKLTVKKGDIDIHKERPVGYKITPEEYAYIKNDIQIIAEA
LLIQFKQGLDRMTAGSDSLKDFKDIITTKKFKKVFPTLSLGLDKEVRKAYRGGFTWLN
DRFKGKEIGEGMVFDINSAYPAQMYVRPLPYGTPLFYQGEYKENIDHPLYIQNLKVRF
RLKERHIPCIQVKQNSLFIQNEYLESSVNKLGVDELIELTLTNVDLDLFFEHYEILEI
HYTYGYMFRASCDMFKDFIDKWTYIKTTSYGAIKQLAKLMLNSLYGKFASNPDVTGKV
PYLKENGALGFRLGEEETKDPVYTPLASFVTAWGRYTTITTAQACYDRIIYCDTDSIH
LTGTKIPDVIKDIVHPKKLGYWEHESTFKRAKYLRQKTYIQDIYMKRVKGYLVQGSPD
DYTDIKFSVKCAGMTDKIKEEVTFENFKVGFSRKMKPKPVQVPGGVVLVDSVFTIK |
| C0227 | 323 | MSRKRFSCDFETTTKLDDCRVWAYGYMEIGNLDNYKIGNSLDEFMQWAMEIQADLYFH
DLKFDGAFIVNWLFKNGFKWCKEAKEERTFSTIISRMGQWYMIDICIGYKGKRKIHTV
IYDSLKKLPFPVEKIAKDFKLTVKKGDIDIHKERPVGYKITPEEYAYIKNDIQIIAEA
LLIQFKQGLDRMTAGSDSLKDFKDIITTKKFKKVFPTLSLGLDKEVRKAYRGGFTWLN
DRFKGKEIGEGMVFDVNSMYPAMMKNKLLPYGEPVMFKGEYKKNVEYPLYIQQVRCFF
ELKKDKIPCIQIKGNARFGQNEYLSTSGDEYVDLYVTNVDWELIKKHYDIFEEEFIGG
FMFKGFIGFFDEYIDRFMEIKNSPDSSAEQSLQAKLMLNSLYGKFASNPDVTGKVPYL
KENGALGFRLGEEETKDPVYTPLASFVTAWGRYTTITTAQACYDRIIYCDTDSIHLTG
TKIPDVIKDIVHPKKLGYWEHESTFKRAKYLRQKTYIQDIYMKRVKGYLVQGSPDDYT
DIKFSVKCAGMTDKIKEEVTFENFKVGFSRKMKPKPVQVPGGVVLVDSVFTIK |
| C0228 | 324 | MSRKRFSCDFETTTKLDDCRVWAYGYMEIGNLDNYKIGNSLDEFMQWAMEIQADLYFH
DLKFDGAFIVNWLFKNGFKWCKEAKEERTFSTIISRMGQWYMIDICIGYKGKRKIHTV
IYDSLKKLPFPVEKIAKDFKLTVKKGDIDIHKERPVGYKITPEEYAYIKNDIQIIAEA
LLIQFKQGLDRMTAGSDSLKDFKDIITTKKFKKVFPTLSLGLDKEVRKAYRGGFTWLN
DRFKGKEIGEGMVFDANSHYPAQMYVRPLPYGTPLFYQGEYKENIDHPLYIQNLKVRF
RLKERHIPCIQVKRSRLFIQNEYLESSVNELIELTLTNVDLDLFFEHYEILEIHYTYG
YMFRASCDMFKDFIDKWTYIKTTSYGAIKQLAKLMLNSLYGKFASNPDVTGKVPYLKE
NGALGFRLGEEETKDPVYTPLASFVTAWGRYTTITTAQACYDRIIYCDTDSIHLTGTK
IPDVIKDIVHPKKLGYWEHESTFKRAKYLRQKTYIQDIYMKRVKGYLVQGSPDDYTDI
KFSVKCAGMTDKIKEEVTFENFKVGFSRKMKPKPVQVPGGVVLVDSVFTIK |
| C0229 | 325 | MSRKRFSCDFETTTKLDDCRVWAYGYMEIGNLDNYKIGNSLDEFMQWAMEIQADLYFH
DLKFDGAFIVNWLFKNGFKWCKEAKEERTFSTIISRMGQWYMIDICIGYKGKRKIHTV
IYDSLKKLPFPVEKIAKDFKLTVKKGDIDIHKERPVGYKITPEEYAYIKNDIQIIAEA
LLIQFKQGLDRMTAGSDSLKDFKDIITTKKFKKVFPTLSLGLDKEVRKAYRGGFTWLN
DRFKGKEIGEGMVFDANSHYPAQMYVRPLPYGTPLFYQGEYKENIDHPLYIQNLKVRF
RLKERHIPCIQVKRSLFIQNEYLESSVNELIELTLTNVDLDLFFEHYEILEIHYTYG
YMFRASCDMFKDFIDKWTYIKTTSYGAIKQLAKLMLNSLYGKFASNPDVTGKVPYLKE
NGALGFRLGEEETKDPVYTPLASFVTAWGRYTTITTAQACYDRIIYCDTDSIHLTGTK
IPDVIKDIVHPKKLGYWEHESTFKRAKYLRQKTYIQDIYMKRVKGYLVQGSPDDYTDI
KFSVKCAGMTDKIKEEVTFENFKVGFSRKMKPKPVQVPGGVVLVDSVFTIK |
| C0230 | 326 | MSRKRFSCDFETTTKLDDCRVWAYGYMEIGNLDNYKIGNSLDEFMQWAMEIQADLYFH
DLKFDGAFIVNWLFKNGFKWCKEAKEERTFSTIISRMGQWYMIDICIGYKGKRKIHTV
IYDSLKKLPFPVEKIAKDFKLTVKKGDIDIHKERPVGYKITPEEYAYIKNDIQIIAEA
LLIQFKQGLDRMTAGSDSLKDFKDIITTKKFKKVFPTLSLGLDKEVRKAYRGGFTWLN
DRFKGKEIGEGMVFDANSHYPAQMYVRPLPYGTPLFYQGEYKENIDHPLYIQNLKVRF
RLKERHIPCIQVKRSLYKQNEYLESSVNELIELTLTNVDLDLFFEHYEILEIHYTYG
YMFRASCDMFKDFIDKWTYIKTTSYGAIKQLAKLMLNSLYGKFASNPDVTGKVPYLKE
NGALGFRLGEEETKDPVYTPLASFVTAWGRYTTITTAQACYDRIIYCDTDSIHLTGTK |

TABLE 3-continued

Chimeric Polymerase Variants

| Name | SEQ ID NO | Sequence |
|---|---|---|
| | | IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0231 | 327 | MSRKRFSCDFETTTKLDDCRVWAYGYMEIGNLDNYKIGNSLDEFMQWAMEIQADLYFH<br>DLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKRSRFYKGNEYLESSVNELIELTLTNVDLDLFFEHYEILEIHYTYG<br>YMFRASCDMFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0232 | 328 | MSRKRFSCDFETTTKLDDCRVWAYGYMEIGNLDNYKIGNSLDEFMQWAMEIQADLYFH<br>DLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKRSLFKQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0233 | 329 | MSRKRFSCDFETTTKLDDCRVWAYGYMEIGNLDNYKIGNSLDEFMQWAMEIQADLYFH<br>DLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKEGYIPTIQIKRSRFYKGNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0234 | 330 | MSRKRFSCDFETTTKLDDCRVWAYGYMEIGNLDNYKIGNSLDEFMQWAMEIQADLYFH<br>DLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKEGYIPTIQIKRSRFYKGNEYLKSSGGELIELTLTNVDLDLFFEHYEILEIHYTYG<br>YMFRASCDMFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0235 | 331 | MSRKRFSCDFETTTKLDDCRVWAYGYMEIGNLDNYKIGNSLDEFMQWAMEIQADLYFH<br>DLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKEGYIPTIQIKRSRFYKGNEYLKSSGGELIELTLTNVDLELMKEHYEILEIHYTYG<br>YMFRASCDMFKDFIDKWTYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0236 | 332 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0237 | 333 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI |

TABLE 3-continued

Chimeric Polymerase Variants

| Name | SEQ ID NO | Sequence |
|---|---|---|
| | | HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0238 | 334 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0239 | 335 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0240 | 336 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKEGYIPTIQIKRSRFYKGNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0241 | 337 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKEGYIPTIQIKRSRFYKGNEYLKSSGGELIELTLTNVDLDLFFEHYEILEIHYTYG<br>YMFRASCDMFKDFIDKWFYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0242 | 338 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKEGYIPTIQIKRSRFYKGNEYLKSSGGELIELTLTNVDLELMKEHYEILEIHYTYG<br>YMFRASCDMFKDFIDKWFYIKTTSYGAIKQLAKLMLNSLYGKFASNPDVTGKVPYLKE<br>NGALGFRLGEEETKDPVYTPLASFVTAWGRYTTITTAQACYDRIIYCDTDSIHLTGTK<br>IPDVIKDIVHPKKLGYWEHESTFKRAKYLRQKTYIQDIYMKRVKGYLVQGSPDDYTDI<br>KFSVKCAGMTDKIKEEVTFENFKVGFSRKMKPKPVQVPGGVVLVDSVFTIK |
| C0243 | 339 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDIIKDLVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0244 | 340 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN |

TABLE 3-continued

Chimeric Polymerase Variants

| Name | SEQ ID NO | Sequence |
|---|---|---|
| | | DRFKGKEIGEGMVFDANSHYPAQMYVRPLPYGTPLFYQGEYKENIDHPLYIQNLKVRF RLKERHIPCIQVKQNSLFIQNEYLESSVNKLGVDELIELTLTNVDLDLFFEHYEILEI HYTYGYMFRASCDMFKDFIDKWFYIKTTSYGAIKQLAKLMLNSLYGKFASNPDVTGKV PYLKENGALGFRLGEEETKDPVYTPLASFVTAWGRYTTITTAQACYDRIIYCDTDSIH LTGTKVPDAIKDLVHPKKLGYWEHESTFKRAKYLRQKTYIQDIYMKRVKGYLVQGSPD DYTDIKFSVKCAGMTDKIKEEVTFENFKVGFSRKMKPKPVQVPGGVVLVDSVFTIK |
| C0245 | 341 | MSRKRFSCDFETTTKLDDCRVWAYGYMEIGNLDNYKIGNSLDEFMQWAMEIQADLYFH NLKFDGAFIVNWLFKNGFKWCKEAKEERTFSTIISRMGQWYMIDICIGYKGKRKIHTV IYDSLKKLPFPVEKIAKDFKLTVKKGDIDIHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDANSHYPAQMYVRPLPYGTPLFYQGEYKENIDHPLYIQNLKVRF RLKERHIPCIQVKQNSLFIQNEYLESSVNKLGVDELIELTLTNVDLDLFFEHYEILEI HYTYGYMFRASCDMFKDFIDKWFYIKTTSYGAIKQLAKLMLNSLYGKFASNPDVTGKV PYLKENGALGFRLGEEETKDPVYTPLASFVTAWGRYTTITTAQACYDRIIYCDTDSIH LTGTKVPDAIKDLVHPKKLGYWEHESTFKRAKYLRQKTYVQDIYMKRVKGYLVQGSPD DYTDIKFSVKCAGMTDKIKEEVTFENFKVGFSRKMKPKPVQVPGGVVLVDSVFTIK |
| C0246 | 342 | MSRKRFSCDFETTTKLDDCRVWAYGYMEIGNLDNYKIGNSLDEFMQWAMEIQADLYFH NLKFDGAFIVNWLFKNGFKWCKEAKEERTFSTIISRMGQWYMIDICIGYKGKRKIHTV IYDSLKKLPFPVEKIAKDFKLTVKKGDIDIHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDANSHYPAQMYVRPLPYGTPLFYQGEYKENIDHPLYIQNLKVRF RLKERHIPCIQVKQNSLFIQNEYLESSVNKLGVDELIELTLTNVDLDLFFEHYEILEI HYTYGYMFRASCDMFKDFIDKWFYIKTTSYGAIKQLAKLMLNSLYGKFASNPDVTGKV PYLKENGALGFRLGEEETKDPVYTPLASFVTAWGRYTTITTAQACYDRIIYCDTDSIH LTGTKVPDIIKDIVHPKKLGYWEHESTFKRAKYLRQKTYIQDIYMKRVKGYLVQGSPD DYTDTKFSVKCAGMTDKIKEEVTFENFKVGFSRKMKPKPVQVPGGVVLVDSVFTIK |
| C0247 | 343 | MSRKRFSCDFETTTKLDDCRVWAYGYMEIGNLDNYKIGNSLDEFMQWAMEIQADLYFH DLKFDGAFIINWLFKNGFKWCKEAKEERTFSTIISRMGQWYMIDICLGYKGKRKIHTV IYDSLKKLPFPVEKIAKDFKLTVKKGDIDIHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDANSHYPAQMYVKNLLPYGEPVMFKGEYKKNVEYPLYIQQVRC FFELKKDKIPCIQIKGNARFGQNEYLSTSGDEYVDLYVTNVDWELIKKHYDIFEEEFI GGFMFKGMFKDFIDKWFYIKTTSYGAIKQLAKLMLNSLYGKFASNPDVTGKVPYLKEN GALGFRLGEEETKDPVYTPLASFVTAWGRYTTITTAQACYDRIIYCDTDSIHLTGTKI PDVIKDIVHPKKLGYWEHESTFKRAKYLRQKTYIQDIYMKRVKGYLVQGSPDDYTDIK FSVKCAGMTDKIKEEVTFENFKVGFSRKMKPKPVQVPGGVVLVDSVFTIK |
| C0248 | 344 | MKHMPRKMYSCDFETTTKVEDCRVWAYGYMNIEDHSEYKIGNSLDEFMAWVLKVQADL YFHNLKFDGAFIINWLFKNGFKWCKEAKEERTFSTIISRMGQWYMIDICLGYKGKRKI HTVIYDSLKKLPFPVEKIAKDFKLTVKKGDIDIHKERPVGYKITPEEYAYIKNDIQII AEALLIQFKQGLDRMTAGSDSLKDFKDIITTKKFKKVFPTLSLGLDKEVRKAYRGGFT WLNDRFKGKEIGEGMVFDANSHYPAQMYSRLLPYGEPIVFEGKYVWDEDYPLHIQHIR CEFELKEGYIPTIQIKRSRFYKGNEYLKSSGGEIADLWLSNVDLELMKEHYDLYNVEY ISGLKFKATTGLFKDFIDKWTYIKTTSYGAIKQLAKLMLNSLYGKFASNPDVTGKVPY LKENGALGFRLGEEETKDPVYTPLASFVTAWGRYTTITTAQACYDRIIYCDTDSIHLT GTKIPDVIKDIVHPKKLGYWEHESTFKRAKYLRQKTYIQDIYMKRVKGYLVQGSPDDY TDIKFSVKCAGMTDKIKEEVTFENFKVGFSRKMKPKPVQVPGGVVLVDSVFTIK |
| C0249 | 345 | MKHMPRKMYSCDFETTTKVEDCRVWAYGYMNIEDHSEYKIGNSLDEFMAWVLKVQADL YFHNLKFDGAFIINWLERNGFKWSADGLPNTYNTIISRMGQWYMIDICLGYKGKRKIH TVIYDSLKKLPFPVKKIAQDFKLTVKKGDIDYHKERPVGYKITPEEYAYIKNDIQIIA EALLIQFKQGLDRMTAGSDSLKGFKDIITTKKFKKVFPTLSLGLDKEVRKAYRGGFTW LNDRFKGKEIGEGMVFDINSAYPAQMYVRPLPYGTPLFYEGEYKENIDYPLYIQNIKV RFRLKERHIPTIQVKQSSLFIQNEYLESSVNKLGVDELIDLTLTNVDLDLFFEHYDIL EIHYTYGYMFKASCDMFKDFIDKWTYIKTTSYGAIKQLAKLMLNSLYGKFASNPDVTG KVPYLKENGALGFRLGEEETKDPVYTPMGVFITAWGRYTTITAAQACYDRIIYCDTDS IHLTGTKIPDVIKDIVHPKKLGYWEHESTFKRAKYLRQKTYIQDIYMKRVRGYLVQGS PDDYTDIKFSVKCAGMTDKIKEEVTFENFKVGFSRKMKPKPVQVPGGVVLVDSVFTIK |
| C0250 | 346 | MKHMPRKMYSCDFETTTKVEDCRVWAYGYMNIEDHSEYKIGNSLDEFMAWVLKVQADL YFHNLKFDGAFIINWLERNGFKWSADGLPNTYNTIISRMGQWYMIDICLGYKGKRKIH TVIYDSLKKLPFPVKKIAQDFKLTVKKGDIDYHKERPVGYKITPEEYAYIKNDIQIIA EALLIQFKQGLDRMTAGSDSLKDFKDIITTKKFKKVFPTLSLGLDKEVRKAYRGGFTW LNDRFKGKEIGEGMVFDINSAYPAQMYSRLLPYGEPIVFEGKYVWDEDHPLHIQHLRC EFELKEGYIPCIQIKQSLFYKGNEYLKSSGGEIAELWLSNVDLELMKEHYELYNVEYI SGLKFRATTGLFKDFIDKWTYIKTTSYGAIKQLAKLMLNSLYGKFASNPDVTGKVPYL KENGALGFRLGEEETKDPVYTPMGVFITAWGRYTTIAAQACYDRIIYCDTDSIHLTG TKIPDVIKDIVHPKKLGYWEHESTFKRAKYLRQKTYIQDIYMKRVRGYLVQGSPDDYT DIKFSVKCAGMTDKIKEEVTFENFKVGFSRKMKPKPVQVPGGVVLVDSVFTIK |
| C0251 | 347 | MKHMPRKMYSCDFETTTKVEDCRVWAYGYMNIEDHSEYKIGNSLDEFMAWVLKVQADL YFHNLKFDGAFIINWLERNGFKWSADGLPNTYNTIISRMGQWYMIDICLGYKGKRKIH |

TABLE 3-continued

Chimeric Polymerase Variants

| Name | SEQ ID NO | Sequence |
|---|---|---|
| | | TVIYDSLKKLPFPVKKIAQDFKLTVKKGDIDYHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDINSAYPAQMYVRPLPYGTPLFYEGEYKENIDHPLYIQNLKV<br>RFRLKERHIPCIQVKQSSLFIQNEYLESSVNKLGVDELIELTLTNVDLDLFFEHYEIL<br>EIHYTYGYMFRASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTKIPDVIKDIVHPKKLGYWEHESTFKRAKYLRQKTYIQDIYMKRVRGYLVQGS<br>PDDYTDIKFSVKCAGMTDKIKEEVTFENFKVGFSRKMKPKPVQVPGGVVLVDSVFTIK |
| C0252 | 348 | MSRKMFSCDFETTTKLDDCRVWAYGYMEIGNLDNYKIGNSLDEFMQWVMEIQADLYFH<br>NLKFDGAFIINWLERGNFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDINSAYPAQMYSRLLPYGEPIVFEGKYVWDEDYPLHIQHRCEFE<br>LKEGYIPTIQIKQSLFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTKI<br>PDVIKDIVHPKKLGYWEHESTFKRAKYLRQKTYIQDIYMKRVRGYLVQGSPDDYTDIK<br>FSVKCAGMTDKIKEEVTFENFKVGFSRKMKPKPVQVPGGVVLVDSVFTIK |
| C0253 | 349 | MKHMPRKMYSCDFETTTKVEDCRVWAYGYMNIEDHSEYKIGNSLDEFMAWVLKVQADL<br>YFHNLKFDGAFIINWLFKNGFKWCKEAKEERTFSTIISRMGQWYMIDICLGYKGKRKI<br>HTVIYDSLKKLPFPVKKIAQDFKLTVKKGDIDYHKERPVGYKITPEEYAYIKNDIQII<br>AEALLIQFKQGLDRMTAGSDSLKGFKDIITTKKFKKVFPTLSLGLDKEVRKAYRGGFT<br>WLNDRFKGKEIGEGMVFDINSAYPAQMYSRLLPYGEPIVFEGKYVWDEDYPLHIQHIR<br>CEFELKEGYIPTIQIKQSLFYKGNEYLKSSGGEIADLWLSNVDLELMKEHYDLYNVEY<br>ISGLKFKATTGLFKDFIDKWTYIKTTSYGAIKQLAKLMLNSLYGKFASNPDVTGKVPY<br>LKENGALGFRLGEEETKDPVYTPMGVFITAWGRYTTITAAQACYDRIIYCDTDSIHLT<br>GTKIPDVIKDIVHPKKLGYWEHESTFKRAKYLRQKTYIQDIYMKRVRGYLVQGSPDDY<br>TDIKFSVKCAGMTDKIKEEVTFENFKVGFSRKMKPKPVQVPGGVVLVDSVFTIK |
| C0254 | 350 | MKHMPRKMYSCDFETTTKVEDCRVWAYGYMNIEDHSEYKIGNSLDEFMAWVLKVQADL<br>YFHNLKFDGAFIVNWLEKNGFKWSAEGLPNTYNTIISRMGQWYMIDICIGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDINSAYPAQMYSRLLPYGEPIVFEGKYVWDEDYPLHIQHIRC<br>EFELKEGYIPTIQIKQSLFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TKIPDVIKDIVHPKKLGYWEHESTFKRAKYLRQKTYIQDIYMKRVRGYLVQGSPDDYT<br>DIKFSVKCAGMTDKIKEEVTFENFKVGFSRKMKPKPVQVPGGVVLVDSVFTIK |
| C0255 | 351 | MSRKMFSCDFETTTKLDDCRVWAYGYMEIGNLDNYKIGNSLDEFMQWVMEIQADLYFH<br>NLKFDGAFIVNWLEKNGFKWSAEGLPNTYNTIISRMGQWYMIDICIGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDINSAYPAQMYSRLLPYGEPIVFEGKYVWDEDYPLHIQHRCEFE<br>LKEGYIPTIQIKQSLFYKGNEYLKSSGGEIADLWLSNVDLELMKEHYDLYNVEYISGL<br>KFKATTGLFKDFIDKWTYIKTTSYGAIKQLAKLMLNSLYGKFASNPDVTGKVPYLKEN<br>GALGFRLGEEETKDPVYTPMGVFITAWGRYTTITAAQACYDRIIYCDTDSIHLTGTKI<br>PDVIKDIVHPKKLGYWEHESTFKRAKYLRQKTYIQDIYMKRVRGYLVQGSPDDYTDIK<br>FSVKCAGMTDKIKEEVTFENFKVGFSRKMKPKPVQVPGGVVLVDSVFTIK |
| C0256 | 352 | MSRKMFSCDFETTTKLDDCRVWAYGYMEIGNLDNYKIGNSLDEFMQWVMEIQADLYFH<br>NLKFDGAFIINWLFKNGFKWCKEAKEERTFSTIISRMGQWYMIDICLGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKGFKDIITTKKFKKVFPTLSLGLDKEVRKAYRGGFTWLN<br>DRFKGKEIGEGMVFDINSAYPAQMYSRLLPYGEPIVFEGKYVWDEDYPLHIQHRCEF<br>ELKEGYIPTIQIKQSLFYKGNEYLKSSGGEIADLWLSNVDLELMKEHYDLYNVEYISG<br>LKFKATTGLFKDFIDKWTYIKTTSYGAIKQLAKLMLNSLYGKFASNPDVTGKVPYLKE<br>NGALGFRLGEEETKDPVYTPMGVFITAWGRYTTITAAQACYDRIIYCDTDSIHLTGTK<br>IPDVIKDIVHPKKLGYWEHESTFKRAKYLRQKTYIQDIYMKRVRGYLVQGSPDDYTDI<br>KFSVKCAGMTDKIKEEVTFENFKVGFSRKMKPKPVQVPGGVVLVDSVFTIK |
| C0257 | 353 | MKHMPRKMYSCDFETTTKVEDCRVWAYGYMNIEDHSEYKIGNSLDEFMAWVLKVQADL<br>YFHNLKFDGAFIINWLERGNFKWSADGLPNTYNTIISRMGQWYMIDICLGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDINSAYPAQMYSRLLPYGEPIVFEGKYVWDEDYPLHIQHIRC<br>EFELKEGYIPTIQIKQSLFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPLASFVTAWGRYTTITTAQACYDRIIYCDTDSIHLTG<br>TKIPDVIKDIVHPKKLGYWEHESTFKRAKYLRQKTYIQDIYMKRVRGYLVQGSPDDYT<br>DIKFSVKCAGMTDKIKEEVTFENFKVGFSRKMKPKPVQVPGGVVLVDSVFTIK |

TABLE 3-continued

Chimeric Polymerase Variants

| Name | SEQ ID NO | Sequence |
|---|---|---|
| C0258 | 354 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKDFKDIITTKKFKKVFPTLSLGLDKEVRKAYRGGFTW<br>LNDRFKGKEIGEGMVFDINSAYPAQMYSRLLPYGEPIVFEGKYVWDEDYPLHIQHIRC<br>EFELKEGYIPTIQIKQSLFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TKVPDAIKDLVHPKKLGYWEHESTFKRAKYLRQKTYVQDIYMKRVRGYLVQGSPDDYT<br>DIKFSVKCAGMTDKIKEEVTFENFKVGFSRKMKPKPVQVPGGVVLVDSVFTIK |
| C0259 | 355 | MKHMPRKMYSCDFETTTKVEDCRVWAYGYMNIEDHSEYKIGNSLDEFMAWVLKVQADL<br>YFHNLKFDGAFIINWLERNGFKWSADGLPNTYNTIISRMGQWYMIDICLGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKDFKDIITTKKFKKVFPTLSLGLDKEVRKAYRGGFTW<br>LNDRFKGKEIGEGMVFDINSAYPAQMYSRLLPYGEPIVFEGKYVWDEDYPLHIQHIRC<br>EFELKEGYIPTIQIKQSLFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPLASFVTAWGRYTTITTAQACYDRIIYCDTDSIHLTG<br>TKVPDAIKDLVHPKKLGYWEHESTFKRAKYLRQKTYVQDIYMKRVRGYLVQGSPDDYT<br>DIKFSVKCAGMTDKIKEEVTFENFKVGFSRKMKPKPVQVPGGVVLVDSVFTIK |
| C0260 | 356 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKDFKDIITTKKFKKVFPTLSLGLDKEVRKAYRGGFTW<br>LNDRFKGKEIGEGMVFDINSAYPAQMYSRLLPYGEPIVFEGKYVWDEDYPLHIQHIRC<br>EFELKEGYIPTIQIKQSLFYKGNEYLKSSGGEIADLWLSNVDLELMKEHYDLYNVEYI<br>SGLKFKATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TKIPDVIKDIVHPKKLGYWEHESTFKRAKYLRQKTYIQDIYMKRVRGYLVQGSPDDYT<br>DIKFSVKCAGMTDKIKEEVTFENFKVGFSRKMKPKPVQVPGGVVLVDSVFTIK |
| C0261 | 357 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMTDKIKEEVTFENFKVGFSRKMKPKPVQVPGGVVLVDSVFTIK |
| C0262 | 358 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKDFKDIITTKKFKKVFPTLSLGLDKEVRKAYRGGFTW<br>LNDRFKGKEIGEGMVFDINSAYPAQMYVRPLPYGTPLFYEGEYKENIDYPLYIQNKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTKIPDVIKDIVHPKKLGYWEHESTFKRAKYLRQKTYIQDIYMKRVRGYLVQGS<br>PDDYTDIKFSVKCAGMTDKIKEEVTFENFKVGFSRKMKPKPVQVPGGVVLVDSVFTIK |
| C0263 | 359 | MSRKRFSCDFETTTKLDDCRVWAYGYMEIGNLDNYKIGNSLDEFMQWAMEIQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMTDKIKEEVTFENFKVGFSRKMKPKPVQVPGGVVLVDSVFTIK |
| C0264 | 360 | MKHMPRKMYSCDFETTTKVEDCRVWAYGYMNIEDHSEYKIGNSLDEFMAWVLKVQADL<br>YFHNLKFDGAFIVNWLEKNGFKWSAEGLPNTYNTIISRMGQWYMIDICIGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKGFKDIITTKKFKKVFPTLSLGLDKEVRKAYRGGFTW<br>LNDRFKGKEIGEGMVFDINSAYPAQMYSRLLPYGEPIVFEGKYVWDEDHPLHIQHLRC<br>EFELKEGYIPCIQIKQSLFYKGNEYLKSSGGEIAELWLSNVDLELMKEHYELYNVEYI<br>SGLKFRATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG |

TABLE 3-continued

Chimeric Polymerase Variants

| Name | SEQ ID NO | Sequence |
|---|---|---|
| | | TKVPDAIKDLVHPKKLGYWEHESTFKRAKYLRQKTYVQDIYMKRVRGYLVQGSPDDYT<br>DIKFSVKCAGMTDKIKEEVTFENFKVGFSRKMKPKPVQVPGGVVLVDSVFTIK |
| C0265 | 361 | MKHMPRKRYSCDFETTTKVEDCRVWAYGYMNIEDHSEYKIGNSLDEFMAWALKVQADL<br>YFHNLKFDGAFIVNWLEKNGFKWSAEGLPNTYNTIISRMGQWYMIDICIGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKDFKDIITTKKFKKVFPTLSLGLDKEVRKAYRGGFTW<br>LNDRFKGKEIGEGMVFDINSAYPAQMYSRLLPYGEPIVFEGKYVWDEDHPLHIQHLRC<br>EFELKEGYIPCIQIKQSLFYKGNEYLKSSGGEIAELWLSNVDLELMKEHYELYNVEYI<br>SGLKFRATTGLFKDFIDKWTYIKTTSYGAIKQLAKLMLNSLYGKFASNPDVTGKVPYL<br>KENGALGFRLGEEETKDPVYTPMGVFITAWGRYTTITAAQACYDRIIYCDTDSIHLTG<br>TKVPDAIKDLVHPKKLGYWEHESTFKRAKYLRQKTYVQDIYMKRVRGYLVQGSPDDYT<br>DIKFSVKCAGMTDKIKEEVTFENFKVGFSRKMKPKPVQVPGGVVLVDSVFTIK |
| C0266 | 362 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKDFKDIITTKKFKKVFPTLSLGLDKEVRKAYRGGFTW<br>LNDRFKGKEIGEGMVFDINSAYPAQMYVRPLPYGTPLFYEGEYKENIDYPLYIQNIKV<br>RFRLKERHIPTIQVKQSSLFIQNEYLESSVNKLGVDELIDLTLTNVDLDLLFFEHYDIL<br>EIHYTYGYMFKASCDMFKDFIDKWTYIKTTSYGAIKQLAKLMLNSLYGKFASNPDVTG<br>KVPYLKENGALGFRLGEEETKDPVYTPLASFVTAWGRYTTITTAQACYDRIIYCDTDS<br>IHLTGTKIPDVIKDIVHPKKLGYWEHESTFKRAKYLRQKTYIQDIYMKRVRGYLVQGS<br>PDDYTDIKFSVKCAGMTDKIKEEVTFENFKVGFSRKMKPKPVQVPGGVVLVDSVFTIK |
| C0267 | 363 | MSRKRFSCDFETTTKLDDCRVWAYGYMEIGNLDNYKIGNSLDEFMQWAMEIQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMTDKIKEEVTFENFKVGFSRKMKPKPVQVPGGVVLVDSVFTIK |
| C0268 | 364 | MKHMPRKRYSCDFETTTKVEDCRVWAYGYMNIEDHSEYKIGNSLDEFMAWALKVQADL<br>YFHNLKFDGAFIVNWLEKNGFKWSAEGLPNTYNTIISRMGQWYMIDICIGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKDFKDIITTKKFKKVFPTLSLGLDKEVRKAYRGGFTW<br>LNDRFKGKEIGEGMVFDINSAYPAQMYVRPLPYGTPLFYEGEYKENIDHPLYIQNLKV<br>RFRLKERHIPCIQVKQSSLFIQNEYLESSVNKLGVDELIELTLTNVDLDLFFEHYEIL<br>EIHYTYGYMFRASCDMFKDFIDKWTYIKTTSYGAIKQLAKLMLNSLYGKFASNPDVTG<br>KVPYLKENGALGFRLGEEETKDPVYTPLASFVTAWGRYTTITTAQACYDRIIYCDTDS<br>IHLTGTKVPDAIKDLVHPKKLGYWEHESTFKRAKYLRQKTYVQDIYMKRVRGYLVQGS<br>PDDYTDIKFSVKCAGMTDKIKEEVTFENFKVGFSRKMKPKPVQVPGGVVLVDSVFTIK |
| C0269 | 365 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQNSLFIQNEYLENSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0270 | 366 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0271 | 367 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQSSLFIQNEYLENSVNKLGVDELIELTLTNVDLDLFFEHYEILEI |

TABLE 3-continued

Chimeric Polymerase Variants

| Name | SEQ ID NO | Sequence |
|---|---|---|
| | | HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0272 | 368 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQNSLFIQNEYLENSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0273 | 369 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0274 | 370 | MSRKRFSCDFETTTKLDDCRVWAYGYMEIGNLDNYKIGNSLDEFMQWAMEIQADLYFH<br>DLKFDGAFIVNWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0275 | 371 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICVGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0276 | 372 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0277 | 373 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKQHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYVQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0278 | 374 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN |

TABLE 3-continued

Chimeric Polymerase Variants

| Name | SEQ ID NO | Sequence |
|---|---|---|
| | | DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIEITLTNVDVDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0279 | 375 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIEITLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0280 | 376 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKQHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0281 | 377 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTVTNVDLDLFFEHYEILEI<br>HYTYGYMFRGSCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0282 | 378 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTVTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0283 | 379 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRGSCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0284 | 380 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTVTNVDLDLFFEHYEILEI<br>HYTYGYMFRGSCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0285 | 381 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV |

TABLE 3-continued

Chimeric Polymerase Variants

| Name | SEQ ID NO | Sequence |
|---|---|---|
| | | IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVDGYLVQGSPD<br>DYTDIKFSVKCAGMTDKIKEEVTFENFKVGFSRKMKPKPVQVPGGVVLVDSVFTIK |
| C0286 | 382 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKLSVKCAGMTDKIKEEVTFENFKVGFSRKMKPKPVQVPGGVVLVDSVFTIK |
| C0287 | 383 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYQGEYKENIDHPLYVQNLKVRF<br>RLKERHIPCIQVKQNSLFIQNEYLENSVNKLGVDELIEITLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0288 | 384 | MSRKRFSCDFETTTKLDDCRVWAYGYMEIGNLDNYKIGNSLDEFMQWAMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQNEYLESSVNKLGVDELIELTLTNVDLDLFFEHYEILEIH<br>YTYGYMFRASCDMFKDFIDKWFYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTKIPDVIKDIVHPKKLGYWEHESTFKRAKYLRQKTYIQDIYMKRVKGYLVQGSPDD<br>YTDIKFSVKCAGMTDKIKEEVTFENFKVGFSRKMKPKPVQVPGGVVLVDSVFTIK |
| C0289 | 385 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0290 | 386 | MSRKRFSCDFETTTKLDDCRVWAYGYMEIGNLDNYKIGNSLDEFMQWAMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQNEYLESSVNKLGVDELIELTLTNVDLDLFFEHYEILEIH<br>YTYGYMFRASCDMFKDFIDKWFYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTKIPDVIKDIVHPKKLGYWEHESTFKRAKYLRQKTYIQDIYMKRVKGYLVQGSPDD<br>YTDIKFSVKCAGMTDKIKEEVTFENFKVGFSRKMKPKPVQVPGGVVLVDSVFTIK |
| C0291 | 387 | MSRKMFSCDFETTTKLDDCRVWAYGYMEIGNLDNYKIGNSLDEFMQWVMEIQADLYFH<br>DLKFDGAFIVNWLEKNGFKWSAEGLPNTYNTIISRMGQWYMIDICIGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQNEYLESSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |

TABLE 3-continued

Chimeric Polymerase Variants

| Name | SEQ ID NO | Sequence |
|---|---|---|
| C0292 | 388 | MSRKRFSCDFETTTKLDDCRVWAYGYMEIGNLDNYKIGNSLDEFMQWAMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQNEYLESSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0293 | 389 | MSRKRFSCDFETTTKLDDCRVWAYGYMEIGNLDNYKIGNSLDEFMQWAMEIQADLYFH<br>DLKFDGAFIVNWLEKNGFKWSAEGLPNTYNTIISRMGQWYMIDICIGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQNEYLESSVNKLGVDELIELTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0294 | 390 | MSRKRFSCDFETTTKLDDCRVWAYGYMEIGNLDNYKIGNSLDEFMQWAMEIQADLYFH<br>DLKFDGAFIVNWLEKNGFKWSAEGLPNTYNTIISRMGQWYMIDICIGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0295 | 391 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWFYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0296 | 392 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQNEYLESSVNKLGVDELIELTLTNVDLDLFFEHYEILEIH<br>YTYGYMFRASCDMFKDFIDKWFYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0297 | 393 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFQGEYKENIDHPLYIQNLKVRFR<br>LKERHIPTIQVKQNSLFIQNEYLENSVNKLGVDELIDLTLTNVDLDLFFEHYEILEIH<br>YTYGYMFRASCDMFKDFIDKWFYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0298 | 394 | MSRKMFSCDFETTTKLDDCRVWAYGYMEIGNLDNYKIGNSLDEFMQWVMEIQADLYFH<br>DLKFDGAFIVNWLEKNGFKWSAEGLPNTYNTIISRMGQWYMIDICIGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWFYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL |

TABLE 3-continued

Chimeric Polymerase Variants

| Name | SEQ ID NO | Sequence |
|---|---|---|
| | | TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0299 | 395 | MSRKMFSCDFETTTKLDDCRVWAYGYMEIGNLDNYKIGNSLDEFMQWVMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKGFKDIITTKKFKKVFPTLSLGLDKEVRKAYRGGFTWLN<br>DRFKGKEIGEGMVFDANSHYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWFYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTEIPDVIKDIVDPKKLGYWEHESTFKRAKYLRQKTYIQDIYMKRVKGYLVQGSPD<br>DYTDIKFSVKCAGMTDKIKKEVTFENFKVGFSRKMKPKPVQVPGGVVLVDETFTIK |
| C0300 | 396 | MSRKRFSCDFETTTKLDDCRVWAYGYMEIGNLDNYKIGNSLDEFMQWAMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQNEYLESSVNKLGVDELIELTLTNVDLDLFFEHYEILEIH<br>YTYGYMFRASCDMFKDFIDKWFYIKTTSYGAIKQLAKLMLNSLYGKFASNPDVTGKVP<br>YLKENGALGFRLGEEETKDPVYTPLASFVTAWGRYTTITTAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0301 | 397 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDINSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0302 | 398 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0303 | 399 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWFYIKTTSYGAIKQLAKLMLNSLYGKFASNPDVTGKV<br>PYLKENGALGFRLGEEETKDPVYTPLASFVTAWGRYTTITTAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0304 | 400 | MSRKRFSCDFETTTKLDDCRVWAYGYMEIGNLDNYKIGNSLDEFMQWAMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAAQACYDRIIYCDTDSIH<br>LTGTEIPDVIKDIVDPKKLGYWEHESTFKRAKYLRQKTYIQDIYMKRVKGYLVQGSPDD<br>YTDIKFSVKCAGMTDKIKKEVTFENFKVGFSRKMKPKPVQVPGGVVLVDETFTIK |
| C0305 | 401 | MSRKMFSCDFETTTKLDDCRVWAYGYMEIGNLDNYKIGNSLDEFMQWVMEIQADLYFH<br>DLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKGFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI |

TABLE 3-continued

Chimeric Polymerase Variants

| Name | SEQ ID NO | Sequence |
|---|---|---|
| | | HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0306 | 402 | MSRKRFSCDFETTTKLDDCRVWAYGYMEIGNLDNYKIGNSLDEFMQWAMEIQADLYFH<br>DLKFDGAFIINWLFRNGFKWCKDAKEERTFSTIISRMGQWYMIDICLGYKGKRKIHTV<br>IYDSLKKLPFPVEKIAKDFKLTVKKGDIDIHKEPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0307 | 403 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYEGEYKENIDHPLYIQNLKVRFR<br>LKERHIPCIQVKQSSLFIQNEYLESSVNKLGVDELIELTLTNVDLDLFFEHYEILEIH<br>YTYGYMFRASCDMFKDFIDKWFYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKEEVTFENFKVGFSRKMKPKPVQVPGGVVLVDETFTIK |
| C0308 | 404 | MSRKMFSCDFETTTKLDDCRVWAYGYMEIGNLDNYKIGNSLDEFMQWVMEIQADLYFH<br>DLKFDGAFIINWLERNGFKWSADGLPNTYNTIISRMGQWYMIDICLGYKGKRKIHTVI<br>YDSLKKLPFPVEKIAKDFKLTVKKGDIDIHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDANSHYPAQMYVRPLPYGTPLFYQGEYKENIDHPLYIQNLKVRFR<br>LKERHIPTIQVKQNSLFIQNEYLENSVNKLGVDELIDLTLTNVDLDLFFEHYEILEIH<br>YTYGYMFRASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTEIPDVIKDIVDPKKLGYWEHESTFKRAKYLRQKTYIQDIYMKRVKGYLVQGSPDD<br>YTDIKFSVKCAGMTDKIKEEVTFENFKVGFSRKMKPKPVQVPGGVVLVDETFTIK |
| C0309 | 405 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMTDKIKEEVTFENFKVGFSRKMKPKPVQVPGGVVLVDSVFTIK |
| C0310 | 406 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKGFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMTDKIKEEVTFENFKVGFSRKMKPKPVQVPGGVVLVDSVFTIK |
| C0311 | 407 | MKHMPRKRYSCDFETTTKVEDCRVWAYGYMNIEDHSEYKIGNSLDEFMAWALKVQADL<br>YFHNLKFDGAFIINWLFKNGFKWCKEAKEERTFSTIISRMGQWYMIDICLGYKGKRKI<br>HTVIYDSLKKLPFPVKKIAQDFKLTVKKGDIDYHKERPVGYKITPEEYAYIKNDIQII<br>AEALLIQFKQGLDRMTAGSDSLKDFKDIITTKKFKKVFPTLSLGLDKEVRKAYRGGFT<br>WLNDRFKGKEIGEGMVFDINSAYPAQMYVRPLPYGTPLFYEGEYKENIDYPLYIQNIK<br>VRFRLKERHIPTIQVKQSSLFIQNEYLESSVNKLGVDELIDLTLTNVDLDLFFEHYDI<br>LEIHYTYGYMFKASCDMFKDFIDKWTYIKTTSYGAIKQLAKLMLNSLYGKFASNPDVT<br>GKVPYLKENGALGFRLGEEETKDPVYTPLASFVTAWGRYTTITTAQACYDRIIYCDTD<br>SIHLTGTKIPDVIKDIVHPKKLGYWEHESTFKRAKYLRQKTYIQDIYMKRVRGYLVQG<br>SPDDYTDIKFSVKCAGMTDKIKEEVTFENFKVGFSRKMKPKPVQVPGGVVLVDSVFTI<br>K |
| C0312 | 408 | MKHMPRKRYSCDFETTTKVEDCRVWAYGYMNIEDHSEYKIGNSLDEFMAWALKVQADL<br>YFHNLKFDGAFIVNWLEKNGFKWSAEGLPNTYNTIISRMGQWYMIDICIGYKGKRKIH<br>TVIYDSLKKLPFPVKKIAQDFKLTVKKGDIDYHKERPVGYKITPEEYAYIKNDIQIIA |

TABLE 3-continued

Chimeric Polymerase Variants

| Name | SEQ ID NO | Sequence |
|---|---|---|
| | | EALLIQFKQGLDRMTAGSDSLKDFKDIITTKKFKKVFPTLSLGLDKEVRKAYRGGFTW<br>LNDRFKGKEIGEGMVFDINSAYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTTSYGAIKQLAKLMLNSLYGKFASNPDVTG<br>KVPYLKENGALGFRLGEEETKDPVYTPLASFVTAWGRYTTITTAQACYDRIIYCDTDS<br>IHLTGTKIPDVIKDIVHPKKLGYWEHESTFKRAKYLRQKTYIQDIYMKRVRGYLVQGS<br>PDDYTDIKFSVKCAGMTDKIKEEVTFENFKVGFSRKMKPKPVQVPGGVVLVDSVFTIK |
| C0313 | 409 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKDFKDIITTKKFKKVFPTLSLGLDKEVRKAYRGGFTW<br>LNDRFKGKEIGEGMVFDINSAYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTTSYGAIKQLAKLMLNSLYGKFASNPDVTG<br>KVPYLKENGALGFRLGEEETKDPVYTPLASFVTAWGRYTTITTAQACYDRIIYCDTDS<br>IHLTGTKVPDAIKDLVHPKKLGYWEHESTFKRAKYLRQKTYVQDIYMKRVRGYLVQGS<br>PDDYTDIKFSVKCAGMTDKIKEEVTFENFKVGFSRKMKPKPVQVPGGVVLVDSVFTIK |
| C0314 | 410 | MSRKMFSCDFETTTKLDDCRVWAYGYMEIGNLDNYKIGNSLDEFMQWVMEIQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTKVPDAIKDLVHPKKLGYWEHESTFKRAKYLRQKTYVQDIYMKRVRGYLVQGSPDD<br>YTDIKFSVKCAGMTDKIKEEVTFENFKVGFSRKMKPKPVQVPGGVVLVDSVFTIK |
| C0315 | 411 | MSRKRFSCDFETTTKLDDCRVWAYGYMEIGNLDNYKIGNSLDEFMQWAMEIQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPLASFVTAWGRYTTITTAQACYDRIIYCDTDSIHL<br>TGTKVPDAIKDLVHPKKLGYWEHESTFKRAKYLRQKTYVQDIYMKRVRGYLVQGSPDD<br>YTDIKFSVKCAGMTDKIKEEVTFENFKVGFSRKMKPKPVQVPGGVVLVDSVFTIK |
| C0316 | 412 | MKHMPRKRYSCDFETTTKVEDCRVWAYGYMNIEDHSEYKIGNSLDEFMAWALKVQADL<br>YFHNLKFDGAFIINWLFKNGFKWCKEAKEERTFSTIISRMGQWYMIDICLGYKGKRKI<br>HTVIYDSLKKLPFPVKKIAQDFKLTVKKGDIDYHKERPVGYKITPEEYAYIKNDIQII<br>AEALLIQFKQGLDRMTAGSDSLKDFKDIITTKKFKKVFPTLSLGLDKEVRKAYRGGFT<br>WLNDRFKGKEIGEGMVFDINSAYPAQMYVRPLPYGTPLFYEGEYKENIDYPLYIQNIK<br>VRFRLKERHIPTIQVKQSSLFIQNEYLESSVNKLGVDELIDLTLTNVDLDLFFEHYDI<br>LEIHYTYGYMFKASCDMFKDFIDKWTYIKTTSYGAIKQLAKLMLNSLYGKFASNPDVT<br>GKVPYLKENGALGFRLGEEETKDPVYTPLASFVTAWGRYTTITTAQACYDRIIYCDTD<br>SIHLTGTKVPDAIKDLVHPKKLGYWEHESTFKRAKYLRQKTYVQDIYMKRVRGYLVQG<br>SPDDYTDIKFSVKCAGMTDKIKEEVTFENFKVGFSRKMKPKPVQVPGGVVLVDSVFTI<br>K |
| C0317 | 413 | MKHMPRKRYSCDFETTTKVEDCRVWAYGYMNIEDHSEYKIGNSLDEFMAWALKVQADL<br>YFHNLKFDGAFIVNWLEKNGFKWSAEGLPNTYNTIISRMGQWYMIDICIGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKDFKDIITTKKFKKVFPTLSLGLDKEVRKAYRGGFTW<br>LNDRFKGKEIGEGMVFDINSAYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTTSYGAIKQLAKLMLNSLYGKFASNPDVTG<br>KVPYLKENGALGFRLGEEETKDPVYTPLASFVTAWGRYTTITTAQACYDRIIYCDTDS<br>IHLTGTKVPDAIKDLVHPKKLGYWEHESTFKRAKYLRQKTYVQDIYMKRVRGYLVQGS<br>PDDYTDIKFSVKCAGMTDKIKEEVTFENFKVGFSRKMKPKPVQVPGGVVLVDSVFTIK |
| C0318 | 414 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKVPDAIKDLVHPKKLGYWEHESTFKRAKYLRQKTYVQDIYMKRVRGYLVQGSPD<br>DYTDIKFSVKCAGMTDKIKEEVTFENFKVGFSRKMKPKPVQVPGGVVLVDSVFTIK |

TABLE 3-continued

Chimeric Polymerase Variants

| Name | SEQ ID NO | Sequence |
|---|---|---|
| C0319 | 415 | MKHMPRKRYSCDFETTTKVEDCRVWAYGYMNIEDHSEYKIGNSLDEFMAWALKVQADL YFHNLKFDGAFIVNWLFKNGFKWCKEAKEERTFSTIISRMGQWYMIDICIGYKGKRKI HTVIYDSLKKLPFPVKKIAQDFKLTVKKGDIDYHKERPVGYKITPEEYAYIKNDIQII AEALLIQFKQGLDRMTAGSDSLKDFKDIITTKKFKKVFPTLSLGLDKEVRKAYRGGFT WLNDRFKGKEIGEGMVFDINSAYPAQMYVRPLPYGTPLFYEGEYKENIDYPLYIQNIK VRFRLKERHIPTIQVKQSSLFIQNEYLESSVNKLGVDELIDLTLTNVDLDLFFEHYDI LEIHYTYGYMFKASCDMFKDFIDKWTYIKTTSYGAIKQLAKLMLNSLYGKFASNPDVT GKVPYLKENGALGFRLGEEETKDPVYTPLASFVTAWGRYTTITTAQACYDRIIYCTD SIHLTGTKVPDAIKDLVHPKKLGYWEHESTFKRAKYLRQKTYVQDIYMKRVRGYLVQG SPDDYTDIKFSVKCAGMTDKIKEEVTFENFKVGFSRKMKPKPVQVPGGVVLVDSVFTI K |
| C0320 | 416 | MSRKMFSCDFETTTKLDDCRVWAYGYMEIGNLDNYKIGNSLDEFMQWVMEIQADLYFH NLKFDGAFIVNWLFKNGFKWCKEAKEERTFSTIISRMGQWYMIDICIGYKGKRKIHTV IYDSLKKLPFPVKKIAQDFKLTVKKGDIDYHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDINSAYPAQMYVRPLPYGTPLFYEGEYKENIDYPLYIQNIKVRF RLKERHIPTIQVKQSSLFIQNEYLESSVNKLGVDELIDLTLTNVDLDLFFEHYDILEI HYTYGYMFKASCDMFKDFIDKWTYIKTTSYGAIKQLAKLMLNSLYGKFASNPDVTGKV PYLKENGALGFRLGEEETKDPVYTPLASFVTAWGRYTTITTAQACYDRIIYCTDSIHL LTGTKIPDVIKDIVHPKKLGYWEHESTFKRAKYLRQKTYIQDIYMKRVRGYLVQGSPD DYTDIKFSVKCAGMTDKIKEEVTFENFKVGFSRKMKPKPVQVPGGVVLVDSVFTIK |
| C0321 | 417 | MKHMPRKRYSCDFETTTKVEDCRVWAYGYMNIEDHSEYKIGNSLDEFMAWALKVQADL YFHNLKFDGAFIVNWLFKNGFKWCKEAKEERTFSTIISRMGQWYMIDICIGYKGKRKI HTVIYDSLKKLPFPVKKIAQDFKLTVKKGDIDYHKERPVGYKITPEEYAYIKNDIQII AEALLIQFKQGLDRMTAGSDSLKDFKDIITTKKFKKVFPTLSLGLDKEVRKAYRGGFT WLNDRFKGKEIGEGMVFDINSAYPAQMYVRPLPYGTPLFYEGEYKENIDYPLYIQNIK VRFRLKERHIPTIQVKQSSLFIQNEYLESSVNKLGVDELIDLTLTNVDLDLFFEHYDI LEIHYTYGYMFKASCDMFKDFIDKWTYIKTTSYGAIKQLAKLMLNSLYGKFASNPDVT GKVPYLKENGALGFRLGEEETKDPVYTPLASFVTAWGRYTTITTAQACYDRIIYCTD SIHLTGTKIPDVIKDIVHPKKLGYWEHESTFKRAKYLRQKTYIQDIYMKRVRGYLVQG SPDDYTDIKFSVKCAGMTDKIKEEVTFENFKVGFSRKMKPKPVQVPGGVVLVDSVFTI K |
| C0322 | 418 | MSRKRFSCDFETTTKLDDCRVWAYGYMEIGNLDNYKIGNSLDEFMQWAMEIQADLYFH NLKFDGAFIINWLFKNGFKWCKEAKEERTFSTIISRMGQWYMIDICLGYKGKRKIHTV IYDSLKKLPFPVKKIAQDFKLTVKKGDIDYHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDANSHYPAQMYVRPLPYGTPLFYEGEYKENIDHPLYIQNLKVRF RLKERHIPCIQVKQSSLFIQNEYLESSVNKLGVDELIELTLTNVDLDLFFEHYEILEI HYTYGYMFRASCDMFKDFIDKWFYIKTTSYGAIKQLAKLMLNSLYGKFASNPDVTGKV PYLKENGALGFRLGEEETKDPVYTPMGVFITAWGRYTTITAAQACYDRIIYCTDSIH LTGTKIPDVIKDIVHPKKLGYWEHESTFKRAKYLRQKTYIQDIYMKRVKGYLVQGSPD DYTDIKFSVKCAGMTDKIKEEVTFENFKVGFSRKMKPKPVQVPGGVVLVDSVFTIK |
| C0323 | 419 | MSRKRFSCDFETTTKLDDCRVWAYGYMEIGNLDNYKIGNSLDEFMQWAMEIQADLYFH NLKFDGAFIINWLFKNGFKWCKEAKEERTFSTIISRMGQWYMIDICLGYKGKRKIHTV IYDSLKKLPFPVKKIAQDFKLTVKKGDIDYHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDANSHYPAQMYVRPLPYGTPLFYEGEYKENIDYPLYIQNIKVRF RLKERHIPTIQVKQSSLFIQNEYLESSVNKLGVDELIDLTLTNVDLDLFFEHYDILEI HYTYGYMFKASCDMFKDFIDKWFYIKTTSYGAIKQLAKLMLNSLYGKFASNPDVTGKV PYLKENGALGFRLGEEETKDPVYTPMGVFITAWGRYTTITAAQACYDRIIYCTDSIH LTGTKIPDVIKDIVHPKKLGYWEHESTFKRAKYLRQKTYIQDIYMKRVKGYLVQGSPD DYTDIKFSVKCAGMTDKIKEEVTFENFKVGFSRKMKPKPVQVPGGVVLVDSVFTIK |
| C0324 | 420 | MSRKRFSCDFETTTKLDDCRVWAYGYMEIGNLDNYKIGNSLDEFMQWAMEIQADLYFH NLKFDGAFIINWLFKNGFKWCKEAKEERTFSTIISRMGQWYMIDICLGYKGKRKIHTV IYDSLKKLPFPVKKIAQDFKLTVKKGDIDYHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDINSAYPAQMYVRPLPYGTPLFYEGEYKENIDHPLYIQNLKVRF RLKERHIPCIQVKQSSLFIQNEYLESSVNKLGVDELIELTLTNVDLDLFFEHYEILEI HYTYGYMFRASCDMFKDFIDKWFYIKTTSYGAIKQLAKLMLNSLYGKFASNPDVTGKV PYLKENGALGFRLGEEETKDPVYTPMGVFITAWGRYTTITAAQACYDRIIYCTDSIH LTGTKIPDVIKDIVHPKKLGYWEHESTFKRAKYLRQKTYIQDIYMKRVKGYLVQGSPD DYTDIKFSVKCAGMTDKIKEEVTFENFKVGFSRKMKPKPVQVPGGVVLVDSVFTIK |
| C0325 | 421 | MSRKRFSCDFETTTKLDDCRVWAYGYMEIGNLDNYKIGNSLDEFMQWAMEIQADLYFH NLKFDGAFIINWLFKNGFKWCKEAKEERTFSTIISRMGQWYMIDICLGYKGKRKIHTV IYDSLKKLPFPVKKIAQDFKLTVKKGDIDYHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDINSAYPAQMYVRPLPYGTPLFYEGEYKENIDYPLYIQNIKVRF RLKERHIPTIQVKQSSLFIQNEYLESSVNKLGVDELIDLTLTNVDLDLFFEHYDILEI HYTYGYMFKASCDMFKDFIDKWFYIKTTSYGAIKQLAKLMLNSLYGKFASNPDVTGKV |

TABLE 3-continued

Chimeric Polymerase Variants

| Name | SEQ ID NO | Sequence |
|---|---|---|
| | | PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0326 | 422 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0327 | 423 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0328 | 424 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0329 | 425 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0330 | 426 | MKHMPRKRYSCDFETTTKVEDCRVWAYGYMNIEDHSEYKIGNSLDEFMAWALKVQADL<br>YFHNLKFDGAFIINWLFKNGFKWCKEAKEERTFSTIISRMGQWYMIDICLGYKGKRKI<br>HTVIYDSLKKLPFPVKKIAQDFKLTVKKGDIDYHKERPVGYKITPEEYAYIKNDIQII<br>AEALLIQFKQGLDRMTAGSDSLKDFKDIITTKKFKKVFPTLSLGLDKEVRKAYRGGFT<br>WLNDRFKGKEIGEGMVFDANSHYPAQMYVRPLPYGTPLFYEGEYKENIDHPLYIQNLK<br>VRFRLKERHIPCIQVKQSSLFIQNEYLESSVNKLGVDELIELTLTNVDLDLFFEHYEI<br>LEIHYTYGYMFRASCDMFKDFIDKWTYIKTTSYGAIKQLAKLMLNSLYGKFASNPDVT<br>GKVPYLKENGALGFRLGEEETKDPVYTPMGVFITAWGRYTTITAAQACYDRIIYCDTD<br>SIHLTGTKIPDVIKDIVHPKKLGYWEHESTFKRAKYLRQKTYIQDIYMKRVKGYLVQG<br>SPDDYTDIKFSVKCAGMTDKIKEEVTFENFKVGFSRKMKPKPVQVPGGVVLVDSVFTI<br>K |
| C0331 | 427 | MKHMPRKRYSCDFETTTKVEDCRVWAYGYMNIEDHSEYKIGNSLDEFMAWALKVQADL<br>YFHNLKFDGAFIINWLFKNGFKWCKEAKEERTFSTIISRMGQWYMIDICLGYKGKRKI<br>HTVIYDSLKKLPFPVKKIAQDFKLTVKKGDIDYHKERPVGYKITPEEYAYIKNDIQII<br>AEALLIQFKQGLDRMTAGSDSLKDFKDIITTKKFKKVFPTLSLGLDKEVRKAYRGGFT<br>WLNDRFKGKEIGEGMVFDANSHYPAQMYVRPLPYGTPLFYEGEYKENIDYPLYIQNIK<br>VRFRLKERHIPTIQVKQSSLFIQNEYLESSVNKLGVDELIDLTLTNVDLDLFFEHYDI<br>LEIHYTYGYMFKASCDMFKDFIDKWTYIKTTSYGAIKQLAKLMLNSLYGKFASNPDVT<br>GKVPYLKENGALGFRLGEEETKDPVYTPMGVFITAWGRYTTITAAQACYDRIIYCDTD<br>SIHLTGTKIPDVIKDIVHPKKLGYWEHESTFKRAKYLRQKTYIQDIYMKRVKGYLVQG<br>SPDDYTDIKFSVKCAGMTDKIKEEVTFENFKVGFSRKMKPKPVQVPGGVVLVDSVFTI<br>K |
| C0332 | 428 | MKHMPRKRYSCDFETTTKVEDCRVWAYGYMNIEDHSEYKIGNSLDEFMAWALKVQADL<br>YFHNLKFDGAFIINWLFKNGFKWCKEAKEERTFSTIISRMGQWYMIDICLGYKGKRKI<br>HTVIYDSLKKLPFPVKKIAQDFKLTVKKGDIDYHKERPVGYKITPEEYAYIKNDIQII |

TABLE 3-continued

Chimeric Polymerase Variants

| Name | SEQ ID NO | Sequence |
|---|---|---|
| | | AEALLIQFKQGLDRMTAGSDSLKDFKDIITTKKFKKVFPTLSLGLDKEVRKAYRGGFT
WLNDRFKGKEIGEGMVFDINSAYPAQMYVRPLPYGTPLFYEGEYKENIDHPLYIQNLK
VRFRLKERHIPCIQVKQSSLFIQNEYLESSVNKLGVDELIELTLTNVDLDLFFEHYEI
LEIHYTYGYMFRASCDMFKDFIDKWTYIKTTSYGAIKQLAKLMLNSLYGKFASNPDVT
GKVPYLKENGALGFRLGEEETKDPVYTPMGVFITAWGRYTTITAAQACYDRIIYCTD
SIHLTGTKIPDVIKDIVHPKKLGYWEHESTFKRAKYLRQKTYIQDIYMKRVKGYLVQG
SPDDYTDIKFSVKCAGMTDKIKEEVTFENFKVGFSRKMKPKPVQVPGGVVLVDSVFTI
K |
| C0333 | 429 | MKHMPRKRYSCDFETTTKVEDCRVWAYGYMNIEDHSEYKIGNSLDEFMAWALKVQADL
YFHNLKFDGAFIINWLFKNGFKWCKEAKEERTFSTIISRMGQWYMIDICLGYKGKRKI
HTVIYDSLKKLPFPVKKIAQDFKLTVKKGDIDYHKERPVGYKITPEEYAYIKNDIQII
AEALLIQFKQGLDRMTAGSDSLKDFKDIITTKKFKKVFPTLSLGLDKEVRKAYRGGFT
WLNDRFKGKEIGEGMVFDINSAYPAQMYVRPLPYGTPLFYEGEYKENIDYPLYIQNIK
VRFRLKERHIPTIQVKQSSLFIQNEYLESSVNKLGVDELIDLTLTNVDLDLFFEHYDI
LEIHYTYGYMFKASCDMFKDFIDKWTYIKTTSYGAIKQLAKLMLNSLYGKFASNPDVT
GKVPYLKENGALGFRLGEEETKDPVYTPMGVFITAWGRYTTITAAQACYDRIIYCTD
SIHLTGTKIPDVIKDIVHPKKLGYWEHESTFKRAKYLRQKTYIQDIYMKRVKGYLVQG
SPDDYTDIKFSVKCAGMTDKIKEEVTFENFKVGFSRKMKPKPVQVPGGVVLVDSVFTI
K |
| C0334 | 430 | MSRKRFSCDFETTTKLDDCRVWAYGYMEIGNLDNYKIGNSLDEFMQWAMEIQADLYFH
NLKFDGAFIINWLERNGFKWSADGLPNTYNTIISRMGQWYMIDICLGYKGKRKIHTVI
YDSLKKLPFPVKKIAQDFKLTVKKGDIDYHKERPVGYKITPEEYAYIKNDIQIIAEAL
LIQFKQGLDRMTAGSDSLKDFKDIITTKKFKKVFPTLSLGLDKEVRKAYRGGFTWLND
RFKGKEIGEGMVFDINSAYPAQMYVRPLPYGTPLFYEGEYKENIDYPLYIQNIKVRFR
LKERHIPTIQVKQSSLFIQNEYLESSVNKLGVDELIDLTLTNVDLDLFFEHYDILEIH
YTYGYMFKASCDMFKDFIDKWFYIKTTSYGAIKQLAKLMLNSLYGKFASNPDVTGKVP
YLKENGALGFRLGEEETKDPVYTPMGVFITAWGRYTTITAAQACYDRIIYCTDSIHL
TGTKIPDVIKDIVHPKKLGYWEHESTFKRAKYLRQKTYIQDIYMKRVRGYLVQGSPDD
YTDIKFSVKCAGMTDKIKEEVTFENFKVGFSRKMKPKPVQVPGGVVLVDSVFTIK |
| C0335 | 431 | MSRKRFSCDFETTTKLDDCRVWAYGYMEIGNLDNYKIGNSLDEFMQWAMEIQADLYFH
NLKFDGAFIINWLFKNGFKWCKEAKEERTFSTIISRMGQWYMIDICLGYKGKRKIHTV
IYDSLKKLPFPVKKIAQDFKLTVKKGDIDYHKERPVGYKITPEEYAYIKNDIQIIAEA
LLIQFKQGLDRMTAGSDSLKDFKDIITTKKFKKVFPTLSLGLDKEVRKAYRGGFTWLN
DRFKGKEIGEGMVFDINSAYPAQMYVRPLPYGTPLFYEGEYKENIDYPLYIQNIKVRF
RLKERHIPTIQVKQSSLFIQNEYLESSVNKLGVDELIDLTLTNVDLDLFFEHYDILEI
HYTYGYMFKASCDMFKDFIDKWTYIKTTSYGAIKQLAKLMLNSLYGKFASNPDVTGKV
PYLKENGALGFRLGEEETKDPVYTPMGVFITAWGRYTTITAAQACYDRIIYCTDSIH
LTGTKIPDVIKDIVHPKKLGYWEHESTFKRAKYLRQKTYIQDIYMKRVRGYLVQGSPD
DYTDIKFSVKCAGMTDKIKEEVTFENFKVGFSRKMKPKPVQVPGGVVLVDSVFTIK |
| C0336 | 432 | MKHMPRKRYSCDFETTTKLDDCRVWAYGYMEIGNLDNYKIGNSLDEFMAWALKVQADL
YFHNLKFDGAFIINWLERNGFKWSADGLPNTYNTIISRMGQWYMIDICLGYKGKRKIH
TVIYDSLKKLPFPVKKIAQDFKLTVKKGDIDYHKERPVGYKITPEEYAYIKNDIQIIA
EALLIQFKQGLDRMTAGSDSLKDFKDIITTKKFKKVFPTLSLGLDKEVRKAYRGGFTW
LNDRFKGKEIGEGMVFDINSAYPAQMYVRPLPYGTPLFYEGEYKENIDYPLYIQNIKV
RFRLKERHIPTIQVKQSSLFIQNEYLESSVNKLGVDELIDLTLTNVDLDLFFEHYDIL
EIHYTYGYMFKASCDMFKDFIDKWTYIKTTSYGAIKQLAKLMLNSLYGKFASNPDVTG
KVPYLKENGALGFRLGEEETKDPVYTPMGVFITAWGRYTTITAAQACYDRIIYCTDS
IHLTGTKIPDVIKDIVHPKKLGYWEHESTFKRAKYLRQKTYIQDIYMKRVRGYLVQGS
PDDYTDIKFSVKCAGMTDKIKEEVTFENFKVGFSRKMKPKPVQVPGGVVLVDSVFTIK |
| C0337 | 433 | MKHMSRKRFSCDFETTTKLDDCRVWAYGYMEIGNLDNYKIGNSLDEFMAWALKVQADL
YFHNLKFDGAFIINWLERNGFKWSADGLPNTYNTIISRMGQWYMIDICLGYKGKRKIH
TVIYDSLKKLPFPVKKIAQDFKLTVKKGDIDYHKERPVGYKITPEEYAYIKNDIQIIA
EALLIQFKQGLDRMTAGSDSLKDFKDIITTKKFKKVFPTLSLGLDKEVRKAYRGGFTW
LNDRFKGKEIGEGMVFDINSAYPAQMYVRPLPYGTPLFYEGEYKENIDYPLYIQNIKV
RFRLKERHIPTIQVKQSSLFIQNEYLESSVNKLGVDELIDLTLTNVDLDLFFEHYDIL
EIHYTYGYMFKASCDMFKDFIDKWTYIKTTSYGAIKQLAKLMLNSLYGKFASNPDVTG
KVPYLKENGALGFRLGEEETKDPVYTPMGVFITAWGRYTTITAAQACYDRIIYCTDS
IHLTGTKIPDVIKDIVHPKKLGYWEHESTFKRAKYLRQKTYIQDIYMKRVRGYLVQGS
PDDYTDIKFSVKCAGMTDKIKEEVTFENFKVGFSRKMKPKPVQVPGGVVLVDSVFTIK |
| C0338 | 434 | MKHMPRKRYSCDFETTTKLDDCRVWAYGYMEIGNLDNYKIGNSLDEFMAWALKVQADL
YFHNLKFDGAFIINWLFKNGFKWCKEAKEERTFSTIISRMGQWYMIDICLGYKGKRKI
HTVIYDSLKKLPFPVKKIAQDFKLTVKKGDIDYHKERPVGYKITPEEYAYIKNDIQII
AEALLIQFKQGLDRMTAGSDSLKDFKDIITTKKFKKVFPTLSLGLDKEVRKAYRGGFT
WLNDRFKGKEIGEGMVFDINSAYPAQMYVRPLPYGTPLFYEGEYKENIDYPLYIQNIK
VRFRLKERHIPTIQVKQSSLFIQNEYLESSVNKLGVDELIDLTLTNVDLDLFFEHYDI
LEIHYTYGYMFKASCDMFKDFIDKWTYIKTTSYGAIKQLAKLMLNSLYGKFASNPDVT
GKVPYLKENGALGFRLGEEETKDPVYTPLASFVTAWGRYTTITTAAQACYDRIIYCTD |

TABLE 3-continued

Chimeric Polymerase Variants

| Name | SEQ ID NO | Sequence |
|---|---|---|
| | | SIHLTGTKVPDAIKDLVHPKKLGYWEHESTFKRAKYLRQKTYVQDIYMKRVRGYLVQG
SPDDYTDIKFSVKCAGMTDKIKEEVTFENFKVGFSRKMKPKPVQVPGGVVLVDSVFTI
K |
| C0339 | 435 | MKHMPRKRYSCDFETTTKVEDCRVWAYGYMNIEDHSEYKIGNSLDEFMAWALKVQADL
YFHNLKFDGAFIINWLERNGFKWSADGLPNTYNTIISRMGQWYMIDICLGYKGKRKIH
TVIYDSLKKLPFPVKKIAQDFKLTVKKGDIDYHKERPVGYKITPEEYAYIKNDIQIIA
EALLIQFKQGLDRMTAGSDSLKDFKDIITTKKFKKVFPTLSLGLDKEVRKAYRGGFTW
LNDRFKGKEIGEGMVFDINSHYPAQMYVRPLPYGTPLFYEGEYKENIDYPLYIQNIKV
RFRLKERHIPTIQVKQSSLFIQNEYLESSVNKLGVDELIDLTLTNVDLDLFFEHYDIL
EIHYTYGYMFKASCDMFKDFIDKWTYIKTTSYGAIKQLAKLMLNSLYGKFASNPDVTG
KVPYLKENGALGFRLGEEETKDPVYTPLASFVTAWGRYTTITTAQACYDRIIYCDTDS
IHLTGTKIPDVIKDIVHPKKLGYWEHESTFKRAKYLRQKTYIQDIYMKRVRGYLVQGS
PDDYTDIKFSVKCAGMTDKIKEEVTFENFKVGFSRKMKPKPVQVPGGVVLVDSVFTIK |
| C0340 | 436 | MKHMPRKRYSCDFETTTKVEDCRVWAYGYMNIEDHSEYKIGNSLDEFMAWALKVQADL
YFHNLKFDGAFIINWLERNGFKWSADGLPNTYNTIISRMGQWYMIDICLGYKGKRKIH
TVIYDSLKKLPFPVKKIAQDFKLTVKKGDIDYHKERPVGYKITPEEYAYIKNDIQIIA
EALLIQFKQGLDRMTAGSDSLKDFKDIITTKKFKKVFPTLSLGLDKEVRKAYRGGFTW
LNDRFKGKEIGEGMVFDINSHYPAQMYVRPLPYGTPLFYEGEYKENIDYPLYIQNIKV
RFRLKERHIPTIQVKQSSLFIQNEYLESSVNKLGVDELIDLTLTNVDLDLFFEHYDIL
EIHYTYGYMFKASCDMFKDFIDKWTYIKTTSYGAIKQLAKLMLNSLYGKFASNPDVTG
KVPYLKENGALGFRLGEEETKDPVYTPMGVFITAWGRYTTITAAQACYDRIIYCDTDS
IHLTGTKIPDVIKDIVHPKKLGYWEHESTFKRAKYLRQKTYIQDIYMKRVRGYLVQGS
PDDYTDIKFSVKCAGMTDKIKEEVTFENFKVGFSRKMKPKPVQVPGGVVLVDSVFTIK |
| C0341 | 437 | MKHMPRKRYSCDFETTTKVEDCRVWAYGYMNIEDHSEYKIGNSLDEFMAWALKVQADL
YFHNLKFDGAFIINWLERNGFKWSADGLPNTYNTIISRMGQWYMIDICLGYKGKRKIH
TVIYDSLKKLPFPVKKIAQDFKLTVKKGDIDYHKERPVGYKITPEEYAYIKNDIQIIA
EALLIQFKQGLDRMTAGSDSLKDFKDIITTKKFKKVFPTLSLGLDKEVRKAYRGGFTW
LNDRFKGKEIGEGMVFDINSAYPAQMYVRPLPYGTPLFYEGEYKENIDYPLYIQNIKV
RFRLKERHIPTIQVKQSSLFIQNEYLESSVNKLGVDELIDLTLTNVDLDLFFEHYDIL
EIHYTYGYMFKASCDMFKDFIDKWTYIKTTSYGAIKQLAKLMLNSLYGKFASNPDVTG
KVPYLKENGALGFRLGEEETKDPVYTPLAVFVTAWGRYTTITTAQACYDRIIYCDTDS
IHLTGTKIPDVIKDIVHPKKLGYWEHESTFKRAKYLRQKTYIQDIYMKRVRGYLVQGS
PDDYTDIKFSVKCAGMTDKIKEEVTFENFKVGFSRKMKPKPVQVPGGVVLVDSVFTIK |
| C0342 | 438 | MKHMPRKRYSCDFETTTKVEDCRVWAYGYMNIEDHSEYKIGNSLDEFMAWALKVQADL
YFHNLKFDGAFIINWLERNGFKWSADGLPNTYNTIISRMGQWYMIDICLGYKGKRKIH
TVIYDSLKKLPFPVKKIAQDFKLTVKKGDIDYHKERPVGYKITPEEYAYIKNDIQIIA
EALLIQFKQGLDRMTAGSDSLKDFKDIITTKKFKKVFPTLSLGLDKEVRKAYRGGFTW
LNDRFKGKEIGEGMVFDINSAYPAQMYVRPLPYGTPLFYEGEYKENIDYPLYIQNIKV
RFRLKERHIPTIQVKQSSLFIQNEYLESSVNKLGVDELIDLTLTNVDLDLFFEHYDIL
EIHYTYGYMFKASCDMFKDFIDKWTYIKTTSYGAIKQLAKLMLNSLYGKFASNPDVTG
KVPYLKENGALGFRLGEEETKDPVYTPLASFVTAWGRYTTITAAQACYDRIIYCDTDS
IHLTGTKIPDVIKDIVHPKKLGYWEHESTFKRAKYLRQKTYIQDIYMKRVRGYLVQGS
PDDYTDIKFSVKCAGMTDKIKEEVTFENFKVGFSRKMKPKPVQVPGGVVLVDSVFTIK |
| C0343 | 439 | MKHMPRKRYSCDFETTTKVEDCRVWAYGYMNIEDHSEYKIGNSLDEFMAWALKVQADL
YFHNLKFDGAFIINWLERNGFKWSADGLPNTYNTIISRMGQWYMIDICLGYKGKRKIH
TVIYDSLKKLPFPVKKIAQDFKLTVKKGDIDYHKERPVGYKITPEEYAYIKNDIQIIA
EALLIQFKQGLDRMTAGSDSLKDFKDIITTKKFKKVFPTLSLGLDKEVRKAYRGGFTW
LNDRFKGKEIGEGMVFDINSAYPAQMYVRPLPYGTPLFYEGEYKENIDYPLYIQNIKV
RFRLKERHIPTIQVKQSSLFIQNEYLESSVNKLGVDELIDLTLTNVDLDLFFEHYDIL
EIHYTYGYMFKASCDMFKDFIDKWTYIKTTSYGAIKQLAKLMLNSLYGKFASNPDVTG
KVPYLKENGALGFRLGEEETKDPVYTPLAVFVTAWGRYTTITAAQACYDRIIYCDTDS
IHLTGTKIPDVIKDIVHPKKLGYWEHESTFKRAKYLRQKTYIQDIYMKRVRGYLVQGS
PDDYTDIKFSVKCAGMTDKIKEEVTFENFKVGFSRKMKPKPVQVPGGVVLVDSVFTIK |
| C0344 | 440 | MKHMSRKRYSCDFETTTKLDDCRVWAYGYMEIGNLDNYKIGNSLDEFMQWAMEIQADL
YFHNLKFDGAFIINWLERNGFKWSADGLPNTYNTIISRMGQWYMIDICLGYKGKRKIH
TVIYDSLKKLPFPVKKIAQDFKLTVKKGDIDYHKERPVGYKITPEEYAYIKNDIQIIA
EALLIQFKQGLDRMTAGSDSLKDFKDIITTKKFKKVFPTLSLGLDKEVRKAYRGGFTW
LNDRFKGKEIGEGMVFDINSAYPAQMYVRPLPYGTPLFYEGEYKENIDYPLYIQNIKV
RFRLKERHIPTIQVKQSSLFIQNEYLESSVNKLGVDELIDLTLTNVDLDLFFEHYDIL
EIHYTYGYMFKASCDMFKDFIDKWTYIKTTSYGAIKQLAKLMLNSLYGKFASNPDVTG
KVPYLKENGALGFRLGEEETKDPVYTPMGVFITAWGRYTTITAAQACYDRIIYCDTDS
IHLTGTKIPDVIKDIVHPKKLGYWEHESTFKRAKYLRQKTYIQDIYMKRVRGYLVQGS
PDDYTDIKFSVKCAGMTDKIKEEVTFENFKVGFSRKMKPKPVQVPGGVVLVDSVFTIK |
| C0345 | 441 | MPRKRYSCDFETTTKVEDCRVWAYGYMEIGNLDNYKIGNSLDEFMQWAMEIQADLYFH
NLKFDGAFIINWLERNGFKWSADGLPNTYNTIISRMGQWYMIDICLGYKGKRKIHTVI
YDSLKKLPFPVKKIAQDFKLTVKKGDIDYHKERPVGYKITPEEYAYIKNDIQIIAEAL
LIQFKQGLDRMTAGSDSLKDFKDIITTKKFKKVFPTLSLGLDKEVRKAYRGGFTWLND
RFKGKEIGEGMVFDINSAYPAQMYVRPLPYGTPLFYEGEYKENIDYPLYIQNIKVRFR |

TABLE 3-continued

Chimeric Polymerase Variants

| Name | SEQ ID NO | Sequence |
|---|---|---|
| | | LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMTDKIKEEVTFENFKVGFSRKMKPKPVQVPGGVVLVDSVFTIK |
| C0346 | 442 | MSRKRFSCDFETTTKLDDCRVWAYGYMNIEDHSEYKIGNSLDEFMQWAMEIQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMTDKIKEEVTFENFKVGFSRKMKPKPVQVPGGVVLVDSVFTIK |
| C0347 | 443 | MSRKRFSCDFETTTKLDDCRVWAYGYMEIGNLDNYKIGNSLDEFMAWALKVQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMTDKIKEEVTFENFKVGFSRKMKPKPVQVPGGVVLVDSVFTIK |
| C0348 | 444 | MSRKRFSCDFETTTKLDDCRVWAYGYMNIEDHSEYKIGNSLDEFMAWALKVQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMTDKIKEEVTFENFKVGFSRKMKPKPVQVPGGVVLVDSVFTIK |
| C0349 | 445 | MPRKRYSCDFETTTKVEDCRVWAYGYMEIGNLDNYKIGNSLDEFMAWALKVQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMTDKIKEEVTFENFKVGFSRKMKPKPVQVPGGVVLVDSVFTIK |
| C0350 | 446 | MPRKRYSCDFETTTKVEDCRVWAYGYMNIEDHSEYKIGNSLDEFMQWAMEIQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFASNPDVTGKVP<br>YLKENGALGFRLGEEETKDPVYTPMGVFITAWGRYTTITAAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMTDKIKEEVTFENFKVGFSRKMKPKPVQVPGGVVLVDSVFTIK |
| C0351 | 447 | MKHMPRKRYSCDFETTTKLDDCRVWAYGYMEIGNLSEYKIGNSLDEFMQWAMKIQADL<br>YFHNLKFDGAFIINWLERNGFKWSADGLPNTYNTIISRMGQWYMIDICLGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKDFKDIITTKKFKKVFPTLSLGLDKEVRKAYRGGFTW<br>LNDRFKGKEIGEGMVFDINSAYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTKIPDVIKDIVHPKKLGYWEHESTFKRAKYLRQKTYIQDIYMKRVRGYLVQGS<br>PDDYTDIKFSVKCAGMTDKIKEEVTFENFKVGFSRKMKPKPVQVPGGVVLVDSVFTIK |
| C0352 | 448 | MKHMPRKRYSCDFETTTKLDDCRVWAYGYMEIGNHSEYKIGNSLDEFMQWAMKIQADL<br>YFHNLKFDGAFIINWLERNGFKWSADGLPNTYNTIISRMGQWYMIDICLGYKGKRKIH<br>TVIYDSLKKLPFPVKKIAQDFKLTVKKGDIDYHKERPVGYKITPEEYAYIKNDIQIIA |

TABLE 3-continued

Chimeric Polymerase Variants

| Name | SEQ ID NO | Sequence |
|---|---|---|
| | | EALLIQFKQGLDRMTAGSDSLKDFKDIITTKKFKKVFPTLSLGLDKEVRKAYRGGFTW<br>LNDRFKGKEIGEGMVFDINSAYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTTSYGAIKQLAKLMLNSLYGKFASNPDVTG<br>KVPYLKENGALGFRLGEEETKDPVYTPMGVFITAWGRYTTITAAQACYDRIIYCDTDS<br>IHLTGTKIPDVIKDIVHPKKLGYWEHESTFKRAKYLRQKTYIQDIYMKRVRGYLVQGS<br>PDDYTDIKFSVKCAGMTDKIKEEVTFENFKVGFSRKMKPKPVQVPGGVVLVDSVFTIK |
| C0352B | 449 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0353 | 450 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFGTNPDITGKV<br>PYMGEDGIVRLTLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMPDRIKELVTFDNFEVGFSSYGKLLPKRTQGGVVLVDTMFTIK |
| C0354 | 451 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFGTNPDITGKV<br>PYMGEDGIVRLTLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0355 | 452 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFGTNPDITGKV<br>PYMGEDGIVRLTLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMPDRIKELVTFDNFEVGFSSYGKLLPKRTQGGVVLVDTMFTIK |
| C0356 | 453 | MSRKRFSCDFETTTKLDDCRVWAYGYMEIGNLDNYKIGNSLDEFMQWAMEIQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFGTNPDITGKVP<br>YMGEDGIVRLTLGEEETKDPVYTPMGVFITAWGRYTTITAAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMPDRIKELVTFDNFEVGFSSYGKLLPKRTQGGVVLVDTMFTIK |
| C0357 | 454 | MKHMPRKRYSCDFETTTKVEDCRVWAYGYMNIEDHSEYKIGNSLDEFMAWALKVQADL<br>YFHNLKFDGAFIINWLERNGFKWSADGLPNTYNTIISRMGQWYMIDICLGYKGKRKIH<br>TVIYDSLKKLPFPVKKIAQDFKLTVKKGDIDYHKERPVGYKITPEEYAYIKNDIQIIA<br>EALLIQFKQGLDRMTAGSDSLKDFKDIITTKKFKKVFPTLSLGLDKEVRKAYRGGFTW<br>LNDRFKGKEIGEGMVFDINSAYPAQMYVRPLPYGTPLFYEGEYKENIDYPLYIQNIKV<br>RFRLKERHIPTIQVKQSSLFIQNEYLESSVNKLGVDELIDLTLTNVDLDLFFEHYDIL<br>EIHYTYGYMFKASCDMFKDFIDKWTYIKTTSYGAIKQLAKLMLNSLYGKFGTNPDITG<br>KVPYMGEDGIVRLTLGEEETKDPVYTPLASFVTAWGRYTTITTAQACYDRIIYCDTDS<br>IHLTGTKIPDVIKDIVHPKKLGYWEHESTFKRAKYLRQKTYIQDIYMKRVRGYLVQGS<br>PDDYTDIKFSVKCAGMPDRIKELVTFDNFEVGFSSYGKLLPKRTQGGVVLVDTMFTIK |

TABLE 3-continued

Chimeric Polymerase Variants

| Name | SEQ ID NO | Sequence |
|---|---|---|
| C0358 | 455 | MSRKRFSCDFETTTKLDDCRVWAYGYMEIGNLDNYKIGNSLDEFMQWAMEIQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFGTNPDITGKVP<br>YMGEDGIVRLTLGEEETKDPVYTPLASFVTAWGRYTTITTAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMTDKIKEEVTFENFKVGFSRKMKPKPVQVPGGVVLVDSVFTIK |
| C0359 | 456 | MSRKRFSCDFETTTKLDDCRVWAYGYMEIGNLDNYKIGNSLDEFMQWAMEIQADLYFH<br>NLKFDGAFIINWLERNGFKWSADGLPNTYNTIISRMGQWYMIDICLGYKGKRKIHTVI<br>YDSLKKLPFPVKKIAQDFKLTVKKGDIDYHKERPVGYKITPEEYAYIKNDIQIIAEAL<br>LIQFKQGLDRMTAGSDSLKDFKDIITTKKFKKVFPTLSLGLDKEVRKAYRGGFTWLND<br>RFKGKEIGEGMVFDINSAYPAQMYVRPLPYGTPLFYEGEYKENIDYPLYIQNIKVRFR<br>LKERHIPTIQVKQSSLFIQNEYLESSVNKLGVDELIDLTLTNVDLDLFFEHYDILEIH<br>YTYGYMFKASCDMFKDFIDKWTYIKTTSYGAIKQLAKLMLNSLYGKFGTNPDITGKVP<br>YMGEDGIVRLTLGEEETKDPVYTPLASFVTAWGRYTTITTAQACYDRIIYCDTDSIHL<br>TGTKIPDVIKDIVHPKKLGYWEHESTFKRAKYLRQKTYIQDIYMKRVRGYLVQGSPDD<br>YTDIKFSVKCAGMPDRIKELVTFDNFEVGFSSYGKLLPKRTQGGVVLVDTMFTIK |
| C0360 | 457 | MSRKMFSCDFETTTKLDDCRVWAYGYMEIGNLDNYKIGNSLDEFMQWVMEIQADLYFH<br>NLKFDGAFIINWLFKNGFKWCKEAKEERTFSTIISRMGQWYMIDICLGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKGFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKEGYIPTIQIKQSLFYKGNEYLKSSGGELIDLTLTNVDLDLFFEHYDILEIHYTYG<br>YMFKASCDMFKDFIDKWTYIKTTSYGAIKQLAKLMLNSLYGKFASNPDVTGKVPYLKE<br>NGALGFRLGEEETKDPVYTPMGVFITAWGRYTTITAAQACYDRIIYCDTDSIHLTGTK<br>IPDVIKDIVHPKKLGYWEHESTFKRAKYLRQKTYIQDIYMKRVRGYLVQGSPDDYTDI<br>KFSVKCAGMTDKIKEEVTFENFKVGFSRKMKPKPVQVPGGVVLVDSVFTIK |
| C0361 | 458 | MSRKMFSCDFETTTKLDDCRVWAYGYMEIGNLDNYKIGNSLDEFMQWVMEIQADLYFH<br>NLKFDGAFIINWLFKNGFKWCKEAKEERTFSTIISRMGQWYMIDICLGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0362 | 459 | MSRKMFSCDFETTTKLDDCRVWAYGYMEIGNLDNYKIGNSLDEFMQWVMEIQADLYFH<br>NLKFDGAFIINWLFKNGFKWCKEAKEERTFSTIISRMGQWYMIDICLGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKGFKDIITTKKFKKVFPTLSLGLDKEVRKAYRGGFTWLN<br>DRFKGKEIGEGMVFDINSAYPAQMYVRPLPYGTPLFYEGEYKENIDHPLYIQNLKVRF<br>RLKERHIPCIQVKRSRLFIQNEYLESSVNELIELTLTNVDLDLFFEHYEILEIHYTYG<br>YMFRASCDMFKDFIDKWTYIKTTSYGAIKQLAKLMLNSLYGKFASNPDVTGKVPYLKE<br>NGALGFRLGEEETKDPVYTPMGVFITAWGRYTTITAAQACYDRIIYCDTDSIHLTGTK<br>IPDVIKDIVHPKKLGYWEHESTFKRAKYLRQKTYIQDIYMKRVRGYLVQGSPDDYTDI<br>KFSVKCAGMTDKIKEEVTFENFKVGFSRKMKPKPVQVPGGVVLVDSVFTIK |
| C0363 | 460 | MSRKMFSCDFETTTKLDDCRVWAYGYMEIGNLDNYKIGNSLDEFMQWVMEIQADLYFH<br>NLKFDGAFIINWLFKNGFKWCKEAKEERTFSTIISRMGQWYMIDICLGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDHPLYIQNLKVRF<br>RLKEGYIPTIQIKRSRFYKGNEYLKSSGGELIELTLTNVDLELMKEHYEILEIHYTYG<br>YMFRASCDMFKDFIDKWTYIKTTSYGAIKQLAKLMLNSLYGKFASNPDVTGKVPYLKE<br>NGALGFRLGEEETKDPVYTPMGVFITAWGRYTTITAAQACYDRIIYCDTDSIHLTGTK<br>IPDVIKDIVHPKKLGYWEHESTFKRAKYLRQKTYIQDIYMKRVRGYLVQGSPDDYTDI<br>KFSVKCAGMTDKIKEEVTFENFKVGFSRKMKPKPVQVPGGVVLVDSVFTIK |
| C0364 | 461 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPMGVFITAWGRYTTITAAQACYDRIIYCDTDSIH |

TABLE 3-continued

Chimeric Polymerase Variants

| Name | SEQ ID NO | Sequence |
|---|---|---|
| | | LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0365 | 462 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSHYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0366 | 463 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0367 | 464 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDVNSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWFYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0368 | 465 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDVNSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0369 | 466 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0370 | 467 | MSRKRFSCDFETTTKLDDCRVWAYGYMEIGNLDNYKIGNSLDEFMQWAMEIQADLYFH<br>NLKFDGAFIINWLFKNGFKWCKEAKEERTFSTIISRMGQWYMIDICLGYKGKRKIHTV<br>IYDSLKKLPFPVEKIAKDFKLTVKKGDIDIHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDANSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPMGVFITAWGRYTTITAAQACYDRIIYCDTDSIH<br>LTGTKIPDVIKDIVHPKKLGYWEHESTFKRAKYLRQKTYIQDIYMKRVKGYLVQGSPD<br>DYTDIKFSVKCAGMTDKIKEEVTFENFKVGFSRKMKPKPVQVPGGVVLVDSVFTIK |
| C0371 | 468 | MSRKMFSCDFETTTKLDDCRVWAYGYMEIGNLDNYKIGNSLDEFMQWMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI |

TABLE 3-continued

Chimeric Polymerase Variants

| Name | SEQ ID NO | Sequence |
|---|---|---|
| | | HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0372 | 469 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTLISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0373 | 470 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTLISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0374 | 471 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0375 | 472 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKDDDGSLGFRVGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0376 | 473 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKDDGILGFRVGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0377 | 474 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKDDGALGFRVGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0378 | 475 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN |

TABLE 3-continued

Chimeric Polymerase Variants

| Name | SEQ ID NO | Sequence |
|---|---|---|
| | | DRFKGKEIGEGMVFDINSAYPAQMYVRPLPYGTPLFYEGEYKENIDYPLYIQNIKVRF RLKERHIPTIQVKQSSLFIQNEYLESSVNKLGVDELIDLTLTNVDLDLFFEHYDILEI HYTYGYMFKASCDMFKDFIDKWTYIKTTSYGAIKQLAKLMLNSLYGKFASNPDVTGKV PYLKEDGALGFRVGEEETKDPVYTPLASFVTAWGRYTTITTAQACYDRIIYCDTDSIH LTGTKIPDVIKDIVHPKKLGYWEHESTFKRAKYLRQKTYIQDIYMKRVRGYLVQGSPD DYTDIKFSVKCAGMTDKIKEEVTFENFKVGFSRKMKPKPVQVPGGVVLVDSVFTIK |
| C0379 | 476 | MSRKMFSCDFETTTKLDDCRVWAYGYMEIGNLDNYKIGNSLDEFMQWVMEIQADLYFH NLKFDGAFIVNWLFKNGFKWCKEAKEERTFSTIISRMGQWYMIDICIGYKGKRKIHTV IYDSLKKLPFPVKKIAQDFKLTVKKGDIDYHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDINSAYPAQMYVRPLPYGTPLFYEGEYKENIDYPLYIQNIKVRF RLKERHIPTIQVKQSSLFIQNEYLESSVNKLGVDELIDLTLTNVDLDLFFEHYDILEI HYTYGYMFKASCDMFKDFIDKWTYIKTTSYGAIKQLAKLMLNSLYGKFASNPDVTGKV PYLKEDGIVRLTLGEEETKDPVYTPLASFVTAWGRYTTITTAQACYDRIIYCDTDSIH LTGTKIPDVIKDIVHPKKLGYWEHESTFKRAKYLRQKTYIQDIYMKRVRGYLVQGSPD DYTDIKFSVKCAGMTDKIKEEVTFENFKVGFSRKMKPKPVQVPGGVVLVDSVFTIK |
| C0380 | 477 | MSRKMFSCDFETTTKLDDCRVWAYGYMEIGNLDNYKIGNSLDEFMQWVMEIQADLYFH NLKFDGAFIVNWLFKNGFKWCKEAKEERTFSTIISRMGQWYMIDICIGYKGKRKIHTV IYDSLKKLPFPVKKIAQDFKLTVKKGDIDYHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDINSAYPAQMYVRPLPYGTPLFYEGEYKENIDYPLYIQNIKVRF RLKERHIPTIQVKQSSLFIQNEYLESSVNKLGVDELIDLTLTNVDLDLFFEHYDILEI HYTYGYMFKASCDMFKDFIDKWTYIKTTSYGAIKQLAKLMLNSLYGKFASNPDVTGKV PYLKEDGIVGFRLGEEETKDPVYTPLASFVTAWGRYTTITTAQACYDRIIYCDTDSIH LTGTKIPDVIKDIVHPKKLGYWEHESTFKRAKYLRQKTYIQDIYMKRVRGYLVQGSPD DYTDIKFSVKCAGMTDKIKEEVTFENFKVGFSRKMKPKPVQVPGGVVLVDSVFTIK |
| C0381 | 478 | MSRKMFSCDFETTTKLDDCRVWAYGYMEIGNLDNYKIGNSLDEFMQWVMEIQADLYFH NLKFDGAFIVNWLFKNGFKWCKEAKEERTFSTIISRMGQWYMIDICIGYKGKRKIHTV IYDSLKKLPFPVKKIAQDFKLTVKKGDIDYHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDINSAYPAQMYVRPLPYGTPLFYEGEYKENIDYPLYIQNIKVRF RLKERHIPTIQVKQSSLFIQNEYLESSVNKLGVDELIDLTLTNVDLDLFFEHYDILEI HYTYGYMFKASCDMFKDFIDKWTYIKTTSYGAIKQLAKLMLNSLYGKFASNPDVTGKV PYLKDDGIVGFRLGEEETKDPVYTPLASFVTAWGRYTTITTAQACYDRIIYCDTDSIH LTGTKIPDVIKDIVHPKKLGYWEHESTFKRAKYLRQKTYIQDIYMKRVRGYLVQGSPD DYTDIKFSVKCAGMTDKIKEEVTFENFKVGFSRKMKPKPVQVPGGVVLVDSVFTIK |
| C0382 | 479 | MSRKMFSCDFETTTKLDDCRVWAYGYMEIGNLDNYKIGNSLDEFMQWVMEIQADLYFH NLKFDGAFIVNWLFKNGFKWCKEAKEERTFSTIISRMGQWYMIDICIGYKGKRKIHTV IYDSLKKLPFPVKKIAQDFKLTVKKGDIDYHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDINSAYPAQMYVRPLPYGTPLFYEGEYKENIDYPLYIQNIKVRF RLKERHIPTIQVKQSSLFIQNEYLESSVNKLGVDELIDLTLTNVDLDLFFEHYDILEI HYTYGYMFKASCDMFKDFIDKWTYIKTTSYGAIKQLAKLMLNSLYGKFASNPDVTGKV PYLKDDGIVGFRVGEEETKDPVYTPLASFVTAWGRYTTITTAQACYDRIIYCDTDSIH LTGTKIPDVIKDIVHPKKLGYWEHESTFKRAKYLRQKTYIQDIYMKRVRGYLVQGSPD DYTDIKFSVKCAGMTDKIKEEVTFENFKVGFSRKMKPKPVQVPGGVVLVDSVFTIK |
| C0383 | 480 | MSRKMFSCDFETTTKLDDCRVWAYGYMEIGNLDNYKIGNSLDEFMQWVMEIQADLYFH NLKFDGAFIVNWLFKNGFKWCKEAKEERTFSTIISRMGQWYMIDICIGYKGKRKIHTV IYDSLKKLPFPVKKIAQDFKLTVKKGDIDYHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDINSAYPAQMYVRPLPYGTPLFYEGEYKENIDYPLYIQNIKVRF RLKERHIPTIQVKQSSLFIQNEYLESSVNKLGVDELIDLTLTNVDLDLFFEHYDILEI HYTYGYMFKASCDMFKDFIDKWTYIKTTSYGAIKQLAKLMLNSLYGKFASNPDVTGKV PYLKDDGAVGFRLGEEETKDPVYTPLASFVTAWGRYTTITTAQACYDRIIYCDTDSIH LTGTKIPDVIKDIVHPKKLGYWEHESTFKRAKYLRQKTYIQDIYMKRVRGYLVQGSPD DYTDIKFSVKCAGMTDKIKEEVTFENFKVGFSRKMKPKPVQVPGGVVLVDSVFTIK |
| C0384 | 481 | MSRKMFSCDFETTTKLDDCRVWAYGYMEIGNLDNYKIGNSLDEFMQWVMEIQADLYFH NLKFDGAFIVNWLFKNGFKWCKEAKEERTFSTIISRMGQWYMIDICIGYKGKRKIHTV IYDSLKKLPFPVKKIAQDFKLTVKKGDIDYHKERPVGYKITPEEYAYIKNDIQIIAEA LLIQFKQGLDRMTAGSDSLKDFKDIITTKKFKKVFPTLSLGLDKEVRKAYRGGFTWLN DRFKGKEIGEGMVFDINSAYPAQMYVRPLPYGTPLFYEGEYKENIDYPLYIQNIKVRF RLKERHIPTIQVKQSSLFIQNEYLESSVNKLGVDELIDLTLTNVDLDLFFEHYDILEI HYTYGYMFKASCDMFKDFIDKWTYIKTTSYGAIKQLAKLMLNSLYGKFASNPDVTGKV PYLKENGIVGFRVGEEETKDPVYTPLASFVTAWGRYTTITTAQACYDRIIYCDTDSIH LTGTKIPDVIKDIVHPKKLGYWEHESTFKRAKYLRQKTYIQDIYMKRVRGYLVQGSPD DYTDIKFSVKCAGMTDKIKEEVTFENFKVGFSRKMKPKPVQVPGGVVLVDSVFTIK |
| C0385 | 482 | MSRKMFSCDFETTTKLDDCRVWAYGYMEIGNLDNYKIGNSLDEFMQWVMEIQADLYFH NLKFDGAFIVNWLFKNGFKWCKEAKEERTFSTIISRMGQWYMIDICIGYKGKRKIHTV |

TABLE 3-continued

Chimeric Polymerase Variants

| Name | SEQ ID NO | Sequence |
|---|---|---|
| | | IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDRIKEEVTFDNFKVGFSRKMKPKPKQVPGGVVLVDSVFTIK |
| C0386 | 483 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDRIKEEVTFDNFKVGFSRKMKPKPVQVPGGVVLVDSVFTIK |
| C0387 | 484 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDRIKEEVTFDNFKVGFSRKMKPKPVQTPGGVVLVDSVFTIK |
| C0388 | 485 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDRIKEEVTFENFKVGFSRKMKPKPVQTPGGVVLVDSVFTIK |
| C0389 | 486 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDTIKEEVTFDNFKVGFSRKMKPKPKQVPGGVVLVDSVFTIK |
| C0390 | 487 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDTIKEEVTFDNFKVGFSRKMKPKPVQVPGGVVLVDSVFTIK |
| C0391 | 488 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDTIKEEVTFDNFKVGFSRKMKPKPVQTPGGVVLVDSVFTIK |

TABLE 3-continued

Chimeric Polymerase Variants

| Name | SEQ ID NO | Sequence |
|---|---|---|
| C0392 | 489 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPIGYKITPEEYAYIKNDIQIIAEA<br>LLIQFKQGLDRMTAGSDSLKDFKDILTTKKFKKVFPTLSLGLDKEIRKAYRGGFTWVN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0393 | 490 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDILTTKKFKKVFPTLSLGLDKEIRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0394 | 491 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTLISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDILTTKKFKKVFPTLSLGLDKEIRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0395 | 492 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTLISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYQGEYKENIDHPLYIQNLKVRF<br>RLKERHIPCIQVKQNSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0396 | 493 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTLISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKDDGALGFRVGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0397 | 494 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTLISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGIVGFRVGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0398 | 495 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTLISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGIVGFRVGEEETKDPVYTPLASFVTAWGRYTTITTAQACYDRIIYCDTDSIH |

TABLE 3-continued

Chimeric Polymerase Variants

| Name | SEQ ID NO | Sequence |
|---|---|---|
| | | LTGTKIPDVIKDIVHPKKLGYWEHESTFKRAKYLRQKTYIQDIYMKRVRGYLVQGSPD<br>DYTDIKFSVKCAGMTDRIKEEVTFDNFKVGFSRKMKPKPKQVPGGVVLVDSVFTIK |
| C0399 | 496 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTLISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGIVGFRVGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDRIKEEVTFDNFKVGFSRKMKPKPVQTPGGVVLVDSVFTIK |
| C0400 | 497 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTLISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDILTTKKFKKVFPTLSLGLDKEIRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGIVGFRVGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDRIKEEVTFDNFKVGFSRKMKPKPVQTPGGVVLVDSVFTIK |
| C0401 | 498 | MSRKRFSCDFETTTKLDDCRVWAYGYMEIGNLDNYKIGNSLDEFMQWAMEIQADLYFH<br>NLKFDGAFIVNWLFKNGFKWCKEAKEERTFSTLISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDILTTKKFKKVFPTLSLGLDKEIRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGIVGFRVGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDRIKEEVTFDNFKVGFSRKMKPKPVQTPGGVVLVDSVFTIK |
| C0402 | 499 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTLISRMGQWYMIDICIGYKGKRKIHTV<br>IYDSLKKLPFPVKKIAQDFKLTVKKGDIDYHKERPIGYKITPEEYAYIKNDIQIIAEA<br>LLIQFKQGLDRMTAGSDSLKDFKDILTTKKFKKVFPTLSLGLDKEIRKAYRGGFTWLN<br>DRFKGKEIGEGMVFDINSAYPAQMYVRPLPYGTPLFYEGEYKENIDHPLYIQNLKVRF<br>RLKERHIPCIQVKQSSLFIQNEYLESSVNKLGVDELIELTLTNVDLDLFFEHYEILEI<br>HYTYGYMFRASCDMFKDFIDKWTYIKTTSYGAIKQLAKLMLNSLYGKFASNPDVTGKV<br>PYLKENGIVGFRVGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDRIKEEVTFDNFKVGFSRKMKPKPVQTPGGVVLVDSVFTIK |
| C0403 | 500 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKDDGSLGFRVGDEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDIKEEVTFENFKVGFSRKMKPKPVQVPGGVVLVDSVFTIK |
| C0404 | 501 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKDDGSLGFRVGDEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDTIKEEVTFDNFAVGFSRKMKPKPVQVPGGVVLVDSVFTIK |
| C0405 | 502 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI |

TABLE 3-continued

Chimeric Polymerase Variants

| Name | SEQ ID NO | Sequence |
|---|---|---|
| | | HYTYGYMFKASCDMFKDFIDKWTYIKTTSYGAIKQLAKLMLNSLYGKFASNPDVTGKV<br>PYLKENGALGFRLGEEETKDPVYTPLAVFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0406 | 503 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKKLTT<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0407 | 504 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKQRTI<br>FYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0408 | 505 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKQRTI<br>FYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0409 | 506 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKNHVV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0410 | 507 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKNHVV<br>FYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0411 | 508 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKGTTQ<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0412 | 509 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKFRVE<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN |

TABLE 3-continued

Chimeric Polymerase Variants

| Name | SEQ ID NO | Sequence |
|---|---|---|
| | | DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0413 | 510 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKFRVE<br>FYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DRFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0414 | 511 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>DKYKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0415 | 512 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>PKYKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0416 | 513 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>PKFKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0417 | 514 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLN<br>PRYKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0418 | 515 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV<br>IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLD<br>PKYKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |
| C0419 | 516 | MSRKMFSCDFETTTKLDDCRVWAYGYMEIGNLDNYKIGNSLDEFMQWVMEIQADLYFH<br>NLKFDGAFIVNWLFKNGFKWCKEAKEERTFSTIISRMGQWYMIDICIGYKGKRKIHTV |

TABLE 3-continued

Chimeric Polymerase Variants

| Name | SEQ ID NO | Sequence |
|---|---|---|
| | | IYDSLKKLPFPVKKIAQDFKLTVKKGDIDYHKERPVGYKITPEEYAYIKNDIQIIAEA<br>LLIQFKQGLDRMTAGSDSLKDFKDIITTKKFKKVFPTLSLGLDKEVRKAYRGGFTWLD<br>PRYKGKEIGEGMVFDINSAYPAQMYVRPLPYGTPLFYEGEYKENIDYPLYIQNIKVRF<br>RLKERHIPTIQVKQSSLFIQNEYLESSVNKLGVDELIDLTLTNVDLDLFFEHYDILEI<br>HYTYGYMFKASCDMFKDFIDKWTYIKTTSYGAIKQLAKLMLNSLYGKFASNPDVTGKV<br>PYLKENGALGFRLGEEETKDPVYTPLASFVTAWGRYTTITTAQACYDRIIYCDTDSIH<br>LTGTKIPDVIKDIVHPKKLGYWEHESTFKRAKYLRQKTYIQDIYMKRVRGYLVQGSPD<br>DYTDIKFSVKCAGMTDKIKEEVTFENFKVGFSRKMKPKPVQVPGGVVLVDSVFTIK |

In some embodiments, a modified recombinant polymerase enzyme of the disclosure is selected from Table 3. In some embodiments, a chimeric polymerase variant (e.g., as listed in Table 3) comprises a majority polymerase sequence having a region or portion of the majority sequence substituted with a corresponding region or portion of a different polymerase sequence. In some embodiments, all of the residues that comprise a region (e.g., domain and/or subdomain) in a majority polymerase sequence are substituted with all of the residues that comprise a corresponding region in a different polymerase sequence. In some embodiments, at least a portion of the residues that comprise a region in a majority polymerase sequence are substituted with at least a portion of the residues that comprise a corresponding region in a different polymerase sequence.

In some embodiments, only a single subdomain in a majority sequence is substituted with a corresponding subdomain of a different sequence. For example, FIG. 4 depicts chimeric polymerase variants selected from Table 3. The six selected variants are shown as polypeptide strands with subdomains as they generally occur within a polypeptide in an amino-terminal to carboxy-terminal orientation. Each of the polypeptide strands of FIG. 4 comprise a polymerase majority sequence of Q001 (black fill), with one or more domains and/or subdomains substituted with one or more corresponding domains and/or subdomains of M2Y polymerase (SEQ ID NO: 2, open fill) or one or more corresponding domains and/or subdomains of *Lucilia cuprina* (SEQ ID NO: 3, stippled fill) and or one or more flanking amino acids.

In some embodiments, a chimeric polymerase variant comprises a majority polymerase sequence having an exonuclease domain substituted from a different polymerase sequence. As shown in FIG. 4, C017 is a chimeric polymerase variant that comprises an exonuclease domain substituted from an M2Y polymerase sequence (e.g., as set forth in SEQ ID NO: 2). Similarly, C020 comprises an exonuclease domain substituted from a *Lucilia cuprina* polymerase sequence (e.g., as set forth in SEQ ID NO: 3). In some embodiments, modification or replacement of an exonuclease domain in a modified polymerase variant may be useful where proofreading capabilities of the polymerase are not desirable (e.g., in sequencing reactions). However, it should be appreciated that additional and alternative domain and/or subdomain substitutions are contemplated for the modified recombinant polymerases of the disclosure.

In some embodiments, a chimeric polymerase variant comprises a majority polymerase sequence having an exonuclease loop substituted from a different polymerase sequence. As used herein, in some embodiments, an "exonuclease loop" refers to a stretch of consecutive amino acids that forms a loop region in an exonuclease domain. For example, FIG. 5A depicts a cartoon illustration of Φ29 polymerase in full perspective 500 and zoomed perspective 502. Zoomed perspective 502, a close-up view of the boxed area shown in full perspective 500, shows a loop region in the exonuclease domain of Φ29 polymerase. Selected loop residues are shown in stick form in zoomed perspective 502, with the stretch of consecutive amino acids that form the exonuclease loop spanning residues N77 through N88. Evolutionary conservation analysis of this region of the exonuclease domain revealed that the loop, and several flanking residues, is relatively poorly conserved. FIG. 5B depicts a homology alignment 504 between exonuclease regions of Φ29 polymerase and a non-limiting set of other polymerases selected from Table 1. Also depicted is a loop homology alignment 506 showing exonuclease loop N77-N88 of Φ29 polymerase and the corresponding exonuclease loop in other polymerases.

Based on the homology analysis showing relatively low conservation in regions corresponding to exonuclease loop N77-N88 of Φ29 polymerase, this provided a source of variation in the search for desirable biochemical properties in a polymerase variant (e.g., desirable for use in sequencing reactions). Accordingly, in some embodiments, a chimeric polymerase variant comprises a majority polymerase sequence having an exonuclease loop substituted from a different polymerase sequence, where an "exonuclease loop" is homologous to exonuclease loop N77-N88 of Φ29 polymerase (e.g., as shown by loop homology alignment 406 in FIG. 5B).

As shown by the example alignment in FIG. 5B, sequence homology analysis can be used to identify an exonuclease loop sequence that is homologous to N77-N88 of Φ29 polymerase. By way of example and not limitation, the loop homology alignment 506 shows homologous exonuclease loop sequences for M2Y (H74-N85), *Lucilia cuprina* (N64-G76), *E. faecium* (N74-R86), *Bacillus* GA-1 (N74-K88), *Bacillus* VMY22 (K80-K91), *Actinomyces* AV-1 (H93-K105), Potato cyst nematode (L86-K99), Iberian lynx gut (D73-R87), *Candidatus* (N85-N98), and *Eggerthella* sp. (V73-K88). Accordingly, in some embodiments, a substituted exonuclease loop can include between around 12 and around 16 amino acids in a region of homology to N77-N88 of Φ29 polymerase. In some embodiments, a substituted exonuclease loop comprises between around 10 amino acids and up to 20 amino acids, between around 5 amino acids and up to 15 amino acids, between around 5 amino acids and up to 20 amino acids, or between around 5 amino acids and 25 amino acids or more, in a region of homology to N77-N88 of Φ29 polymerase.

In some embodiments, a modified polymerase of the present application comprises one or more amino acid mutations in a region of an exonuclease domain that includes an exonuclease loop of homology to N77-N88 of Φ29 polymerase. For example, in some embodiments, a modified polymerase of the disclosure is a modified Φ29 polymerase comprising mutations at one or more of E75, R76, S82, A83, D84, G85, L86, P87, N88, Y90, and N91 in Φ29 polymerase. In some embodiments, the modified polymerase comprises one or more of E75F, R76K, S82C, A83K, D84E, G85A, L86K, P87E, N88R, Y90F, and N91S. In some embodiments, a modified polymerase comprises one or more amino acid mutations at positions corresponding to E75, R76, S82, A83, D84, G85, L86, P87, N88, Y90, and N91 in Φ29 polymerase. For example, in some embodiments, where a modified polymerase does not comprise a Φ29 polymerase majority sequence, the modified polymerase comprises one or more amino acids that correspond to the positions listed above, e.g., as determined by homology alignment or other methods known in the art.

In some embodiments, a chimeric polymerase variant comprises a majority polymerase sequence having a TPR1 subdomain substituted from a different polymerase sequence. For example, C018 is a chimeric polymerase that comprises a TPR1 subdomain substituted from an M2Y polymerase sequence. Similarly, C021 comprises a TPR1 subdomain substituted from a Lucilia cuprina polymerase. In some embodiments, a chimeric polymerase variant comprises a majority polymerase sequence having a palm subdomain substituted from a different polymerase sequence. In some embodiments, a chimeric polymerase variant comprises a majority polymerase sequence having a fingers subdomain substituted from a different polymerase sequence. In some embodiments, a chimeric polymerase variant comprises a majority polymerase sequence having a TPR2 subdomain substituted from a different polymerase sequence. In some embodiments, a chimeric polymerase variant comprises a majority polymerase sequence having a thumb subdomain substituted from a different polymerase sequence. As described herein, modified recombinant polymerases include chimeric polymerase variants comprising more than one domain and/or subdomain substitution.

In some embodiments, two regions (e.g., domains/subdomains) in a majority sequence are substituted with two corresponding regions (e.g., corresponding domains/subdomains) of a different sequence. For example, as shown in FIG. 4, C019 is a chimeric polymerase that comprises an exonuclease domain and TPR1 subdomain substituted with corresponding exonuclease domain and TPR1 subdomain of an M2Y polymerase sequence. Similarly, C022 comprises exonuclease domain and TPR1 subdomain substituted with corresponding exonuclease domain and TPR1 subdomain of a Lucilia cuprina polymerase. In some embodiments, additional domain and/or subdomain substitutions are contemplated with the modified polymerases described herein. For example, in some embodiments, more than two (e.g., three, four, five, or six) regions (e.g., domains/subdomains) in a majority sequence are substituted with more than two (e.g., three, four, five, or six) corresponding regions of a different sequence.

In some embodiments, a majority polymerase sequence of a chimeric polymerase variant is selected from a sequence in Tables 1-3. In some embodiments, the majority polymerase sequence comprises one or more regions and/or portions substituted from a different polymerase sequence selected from Tables 1-3. For example, Table 4 provides an overview of selected chimeric polymerase variants from Table 3 and lists a majority polymerase sequence for each along with a description of the substituted region(s)/portion(s) and the sequence from which the substitution was based.

TABLE 4

| Chimeric Polymerases - Substituted Portions | | | |
|---|---|---|---|
| Name | Majority Sequence | Source of Substituted Sequence | Region(s)/Portion(s) Substituted |
| C001 | Q001 | M2Y (SEQ ID NO: 2) | Exonuclease, TPR1 |
| C002 | Q001 | M2Y (SEQ ID NO: 2) | Exonuclease, TPR1 |
| C003 | Q001 | M2Y (SEQ ID NO: 2) | Exonuclease, TPR1 |
| C010 | Q001 | Enterococcus faecium (SEQ ID NO: 5) | Exonuclease |
| C011 | Q001 | Enterococcus faecium (SEQ ID NO: 5) | Exonuclease |
| C012 | Q001 | Enterococcus faecium (SEQ ID NO: 5) | TPR1 |
| C013 | Q001 | Enterococcus faecium (SEQ ID NO: 5) | TPR1 |
| C014 | Q001 | Enterococcus faecium (SEQ ID NO: 5) | Exonuclease, TPR1 |
| C015 | Q001 | Enterococcus faecium (SEQ ID NO: 5) | Exonuclease, TPR1 |
| C016 | Q002 | M2Y (SEQ ID NO: 2) | Exonuclease |
| C017 | Q001 | M2Y (SEQ ID NO: 2) | Exonuclease |
| C018 | Q001 | M2Y (SEQ ID NO: 2) | TPR1 |
| C019 | Q001 | M2Y (SEQ ID NO: 2) | Exonuclease, TPR1 |
| C020 | Q001 | Lucilia cuprina (SEQ ID NO: 3) | Exonuclease |
| C021 | Q001 | Lucilia cuprina (SEQ ID NO: 3) | TPR1 |
| C022 | Q001 | Lucilia cuprina (SEQ ID NO: 3) | Exonuclease, TPR1 |
| C023 | Q001 | Enterococcus faecium (SEQ ID NO: 5) | Exonuclease |
| C024 | Q001 | Enterococcus faecium (SEQ ID NO: 5) | Exonuclease |
| C029 | C017 | Enterococcus faecium (SEQ ID NO: 5) | Stretch of 53 residues substituted in from Enterococcus faecium |

TABLE 4-continued

Chimeric Polymerases - Substituted Portions

| Name | Majority Sequence | Source of Substituted Sequence | Region(s)/Portion(s) Substituted |
|---|---|---|---|
| C030 | C013 | *Enterococcus faecium* (SEQ ID NO: 5) | Stretch of 56 residues substituted in from *Enterococcus faecium* |
| C031 | C013 | M2Y (SEQ ID NO: 2) | Stretch of 56 residues substituted in from M2Y |
| C032 | C013 | *Actinomyces* phage AV-1 (SEQ ID NO: 8) | Stretch of 75 residues substituted in from *Actinomyces* phage AV-1 |
| C033 | C013 | *Eggerthella* sp. (SEQ ID NO: 11) | Stretch of 58 residues substituted in from *Eggerthella* sp. |
| C034 | Q001 | M2Y (SEQ ID NO: 2), *Enterococcus faecium* (SEQ ID NO: 5) | Exonuclease from M2Y, TPR1 from *Enterococcus faecium* |
| C035 | Q001 | *Enterococcus faecium* (SEQ ID NO: 5) | TPR1, Finger, Thumb |
| C036 | Q001 | *Enterococcus faecium* (SEQ ID NO: 5) | TPR1, TPR2, Thumb |
| C037 | Q001 | *Actinomyces* phage AV-1 (SEQ ID NO: 8) | TPR1 |
| C038 | Q001 | *Eggerthella* sp. (SEQ ID NO: 11) | TPR1 |
| C039 | C013 | M2Y (SEQ ID NO: 2) | Residues 1-85 substituted in from M2Y |
| C040 | C013 | M2Y (SEQ ID NO: 2) | Residues 1-85, 121-180 substituted in from M2Y |
| C041 | C013 | M2Y (SEQ ID NO: 2) | Residues 1-56 substituted in from M2Y |
| C042 | C013 | M2Y (SEQ ID NO: 2) | Residues 1-56 substituted in from M2Y |
| C043 | C031 | Q001 | Palm |
| C044 | C031 | Q001 | Palm |
| C045 | C031 | Q001 | Palm |
| C046 | C031 | Q001 | Palm |
| C047 | C031 | Q001 | Palm |
| C048 | C031 | Q001 | Palm |
| C049 | C031 | Q001 | Palm |
| C050 | C031 | Q001 | Palm |
| C051 | C032 | Q001 | Palm |
| C052 | C032 | Q001 | Palm |
| C053 | C032 | Q001 | Palm |
| C054 | C032 | Q001 | Palm |
| C055 | C032 | Q001 | Palm |
| C056 | C032 | Q001 | Palm |
| C057 | C032 | Q001 | Palm |
| C058 | C032 | Q001 | Palm |
| C059 | C033 | *Enterococcus faecium* (SEQ ID NO: 5) | TPR2, Thumb |
| C060 | C033 | *Enterococcus faecium* (SEQ ID NO: 5) | TPR2 |
| C061 | C033 | *Enterococcus faecium* (SEQ ID NO: 5) | Thumb |
| C062 | C034 | *Enterococcus faecium* (SEQ ID NO: 5) | TPR2, Thumb |
| C063 | C034 | *Enterococcus faecium* (SEQ ID NO: 5) | TPR2 |
| C064 | C034 | *Enterococcus faecium* (SEQ ID NO: 5) | Thumb |
| C0190 | Q035 | M2Y (SEQ ID NO: 2), *Enterococcus faecium* (SEQ ID NO: 5) | residues 271-375 from *E. faecium* substituted in place of 260-359; residues 1-51 from M2Y substituted in place of 1-54; residues 72-89 from *E. faecium* substituted in place of 75-91; residues 445-449 from *E. faecium* substituted in place of 429-433 |
| C0256 | Q035 | M2Y (SEQ ID NO: 2), *Enterococcus faecium* (SEQ ID NO: 5) | residues 1-51 from M2Y substituted in place of 1-54; residues 72-89 from *E. faecium* substituted in place of 75-91 |
| C0267 | Q035 | M2Y (SEQ ID NO: 2), *Enterococcus faecium* (SEQ ID NO: 5) | residues 271-375 from *E. faecium* substituted in place of 260-359; residues 1-51 from M2Y substituted in place of 1-54; residues 445-449 from *E. faecium* substituted in place of 429-433 |
| C0320 | Q035 | M2Y (SEQ ID NO: 2), *Enterococcus faecium* (SEQ ID NO: 5) | residues 271-375 from *E. faecium* substituted in place of 260-359; residues 1-51 from M2Y substituted in place of 1-54; residues 72-89 from *E. faecium* substituted in place of 75-91; residues 445-449 from *E. faecium* substituted in place of 429-433 |

TABLE 4-continued

Chimeric Polymerases - Substituted Portions

| Name | Majority Sequence | Source of Substituted Sequence | Region(s)/Portion(s) Substituted |
|---|---|---|---|
| C0334 | Q035 | M2Y (SEQ ID NO: 2), Enterococcus faecium (SEQ ID NO: 5) | residues 271-375 from E. faecium substituted in place of 260-359; residues 1-51 from M2Y substituted in place of 1-54 |
| C0364 | Q035 | M2Y (SEQ ID NO: 2), Enterococcus faecium (SEQ ID NO: 5) | residues 271-375 from E. faecium substituted in place of 260-359; residues 1-51 from M2Y substituted in place of 1-54; residues 72-89 from E. faecium substituted in place of 75-91; residues 445-449 from E. faecium substituted in place of 429-433 |

However, other chimeras, for example as described and illustrated in one or more of the Tables herein can be used and/or further modified.

In some embodiments, a chimeric polymerase variant may further comprise one or more site-specific mutations. Thus, in some embodiments, any of the one or more mutations described herein (e.g., any of the one or more mutations included in each sequence in Table 2) may be applied to any of the chimeric polymerases contemplated in the present disclosure (e.g., as described in the above and listed in Table 3). FIG. 6 generally depicts chimeric polymerase variants comprising one or more mutations. For example, mutant chimeric polymerase 602 comprises a Φ29 polymerase majority sequence having a substituted M2Y exonuclease domain and mutations within the substituted domain. In some embodiments, a mutant chimeric polymerase comprises a majority sequence with two or more regions substituted with regions corresponding to two or more different polymerase sequences. For example, mutant chimeric polymerase 604 comprises a Φ29 polymerase majority sequence having a substituted Enterococcus faecium polymerase TPR1 subdomain and a substituted M2Y polymerase TPR2 subdomain, with site-specific mutations made at various positions in the polymerase sequence. In some embodiments, a mutant chimeric polymerase comprises a majority sequence with two or more regions substituted with regions corresponding to a different polymerase. For example, mutant chimeric polymerase 606 comprises a Φ29 polymerase majority sequence having substituted Enterococcus faecium polymerase TPR1, TPR2, and thumb subdomains, with site-specific mutations made at various positions in the polymerase sequence.

Table 5 provides an overview of selected chimeric polymerase variants from Table 3, which provides a majority polymerase sequence for each along with a description of the amino acid mutations made to the particular variant.

TABLE 5

Chimeric Polymerases - Site-Specific Mutants

| Name | Majority Sequence | Description |
|---|---|---|
| C004 | C017 | L259I, E264D, E269D, E276D, D277E, E293D |
| C005 | C017 | L259I, E264D, E269D, E276D, D277E, E288D, E293D, E319D, I320L, A321V, D322E |
| C006 | C017 | L259I, E264D, E269D, E276D, D277E, E288D, E293D, E319D, I320L, A321V, D322E L325I, N327Q, L330I, E331D, D338E, I345L, L348I, K351R, L356I |
| C007 | C017 | K15R, I37L, Q52N, I67L, K77R |

TABLE 5-continued

Chimeric Polymerases - Site-Specific Mutants

| Name | Majority Sequence | Description |
|---|---|---|
| C008 | C017 | K15R, I37L, Q52N, I67L, K77R, L259I, E264D, E269D, E276D, D277E, E288D, E293D, E319D, I320L, A321V, D322E L325I, N327Q, L330I, E331D, D338E, I345L, L348I, K351R, L356I |
| C009 | C006 | L259I, E264D, E269D, E276D, D277E, E288D, E293D, I320L, A321V, D322E, W324Y, L325V, S326T, V328I, E331D, M333I, D338E, I345L, K351R |
| C025 | C017 | I464V, D466E, V467A, K469E, D470H, I471L, P474S, K487Q, Y491F, L492I |
| C026 | C017 | I464V, D466E, V467A, K469E, D470H, I471L, K487Q, Y491F, L492I |
| C027 | C017 | M503V, R505K, K507G, G513C, D517E, Y518A, D520T, I521T |
| C028 | C017 | Mutations in 464-497 and 498-554 regions |

However, other amino acid mutations can be incorporated into one or more chimeric polymerases described herein. For example, one or more amino acids changes can be incorporated at one or more of positions M8, V51, N62, I71, L107, and/or K131, and/or at one or more of positions K135, L142, G197, Y224, E239, V250, L253, Y281, I288, T301, R306, R308, D325, D341, K354, T368, E375, A437, A444, E466, D476, A484, E508, D510, K512, E515, K539, D570, and T571 with reference to the Φ29 polymerase sequence. For example, in some embodiments, a chimeric polymerase also may include one or more of the following amino acid substitutions: M8R, V51A, N62D, I71V, L107I, and/or K131E, and/or one or more of the following amino acid substitutions: K135Q, L142K, G197D, Y224K, E239G, V250A, V250I, L253A, L253H, Y281H, I288L, T301C, R306Q, R308L, D325E, D341E, K354R, T368F, E375Y, A437G, A444T, E466K, D476H, A484E, E508R, D510K, D510R, K512Y, E515Q, K539E, D570S, and/or T571V.

The terms "polymerase" and "polymerizing enzyme," as used herein, generally refer to any enzyme capable of catalyzing a polymerization reaction. Examples of polymerases include, but are not limited to, a DNA polymerase, an RNA polymerase, a thermostable polymerase, a wild-type polymerase, a modified polymerase, E. coli DNA polymerase I, T7 DNA polymerase, bacteriophage T4 DNA polymerase Φ29 (phi29) DNA polymerase, Taq polymerase, Tth polymerase, Tli polymerase, Pfu polymerase, Pwo polymerase, VENT® polymerase, Deep VENT™ polymerase, Ex TAQ™ polymerase, LA TAQ™ polymerase, Sso polymerase, Poc polymerase, Pab polymerase, Mth polymerase, ES4 polymerase, Tru polymerase, Tac polymerase, Tne polymerase, Tma polymerase, Tca polymerase, Tih polymerase, Tfi polymerase, PLATINUM® Taq polymerases, Tbr polymerase, Tfl polymerase, Tth polymerase, PFU-TURBO® polymerase, PYROBEST™ polymerase, Pwo polymerase, KOD polymerase, Bst polymerase, Sac polymerase, Klenow fragment, polymerase with 3' to 5' exonuclease activity, and variants, modified products and derivatives thereof. In some embodiments, the polymerase is a single subunit polymerase. Additional example of polymerases include M2Y polymerase, *Lucilia cuprina* polymerase, *Enterococcus faecium* polymerase, *Bacillus* phage VMY22 polymerase, *Bacillus* phage GA-1 polymerase, *Actinomyces* phage AV-1 polymerase, *Candidatus Moranbacteria* polymerase, *Bacillus* phage MG-B1 polymerase, *Eggerthella* sp. polymerase, *Streptococcus* phage CP-7 polymerase, *Bacteroides* sp. polymerase, *Chlamydia trachomatis* polymerase, and *Globodera pallida* polymerase. Non-limiting examples of DNA polymerases and their properties are described in detail in, among other places, DNA Replication 2nd edition, Kornberg and Baker, W. H. Freeman, New York, N.Y. (1991). Non-limiting examples of such sequences can be found in Table 1 (SEQ ID NOs: 1-19).

Upon base pairing between a nucleobase of a target nucleic acid and the complementary dNTP, the polymerase incorporates the dNTP into the newly synthesized nucleic acid strand by forming a phosphodiester bond between the 3' hydroxyl end of the newly synthesized strand and the alpha phosphate of the dNTP. In some embodiments, the polymerase is a polymerase with high processivity. However, in some embodiments, the polymerase is a polymerase with reduced processivity. Polymerase processivity generally refers to the capability of a polymerase to consecutively incorporate dNTPs into a nucleic acid template without releasing the nucleic acid template.

In some embodiments, the polymerase is a polymerase with low 5'-3' exonuclease activity and/or 3'-5' exonuclease. In some embodiments, the polymerase is modified (e.g., by amino acid substitution) to have reduced 5'-3' exonuclease activity and/or 3'-5' activity relative to a corresponding wild-type polymerase. Further non-limiting examples of DNA polymerases include 9° NM™ DNA polymerase (New England Biolabs), and a P680G mutant of the Klenow exo-polymerase (Tuske et al. (2000) JBC 275(31):23759-23768). In some embodiments, a polymerase having reduced processivity provides increased accuracy for sequencing templates containing one or more stretches of nucleotide repeats (e.g., two or more sequential bases of the same type).

The processivity, exonuclease activity, relative affinity for different types of nucleic acid, or other property of a nucleic acid polymerase can be increased or decreased by one of skill in the art by mutation or other modification relative to a corresponding wild-type polymerase.

In some embodiments, a modified polymerase comprises one or more unnatural amino acid substitutions. As used herein, an "unnatural amino acid" refers to any amino acid, modified amino acid, or amino acid analogue other than the following twenty genetically encoded alpha-amino acids: alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, valine. In some embodiments, unnatural amino acids may include naturally occurring compounds other than the twenty alpha-amino acids above. Unnatural amino acids and methods of incorporating unnatural amino acids into protein sequences are known in the art, for example, as described in U.S. Pat. No. 7,045,337, the contents of which are incorporated herein by reference.

As described herein, polymerases and/or polymerase sequences are "homologous" when they are derived, naturally or artificially, from a common ancestral protein or protein sequence. Similarly, nucleic acids and/or nucleic acid sequences are homologous when they are derived, naturally or artificially, from a common ancestral nucleic acid or nucleic acid sequence. For example, any naturally occurring nucleic acid can be modified by any available mutagenesis method to include at least one specific codon that encodes for an amino acid that does not naturally occur at a given position in the polypeptide. When expressed, this mutagenized nucleic acid encodes a polypeptide comprising one or more mutated amino acids. In some embodiments, homology is generally inferred from sequence similarity between two or more nucleic acids or proteins (or sequences thereof). The precise percentage of similarity between sequences that is useful in establishing homology varies with the nucleic acid and protein at issue, but as little as 25% sequence similarity is routinely used to establish homology. Higher levels of sequence similarity, e.g., 30%, 40%, 50%, 60%, 70%, 80%, 90%, 95% or 99% or more can also be used to establish homology. Methods for determining sequence similarity percentages are well known in the art. In some embodiments, similarity can be determined using algorithms such as those described above, including for example BLASTP and BLASTN algorithms, for example, using default parameters.

In some embodiments, to express a polymerase of the disclosure, DNA encoding the polymerase is inserted into one or more expression vectors such that the encoded polymerase is operatively linked to transcriptional and translational control sequences (see, e.g., U.S. Pat. No. 6,914,128, the contents of which is incorporated herein by reference). In this context, the term "operatively linked" is intended to mean that a sequence encoding the polymerase is ligated into a vector such that transcriptional and translational control sequences within the vector serve their intended function of regulating the transcription and translation of the polymerase. The expression vector and expression control sequences are chosen to be compatible with the expression host cell used. Polymerase-encoding sequences are inserted into expression vectors by standard methods (e.g., ligation of complementary restriction sites on the polymerase-encoding sequence and vector or blunt end ligation if no restriction sites are present).

For expression of a modified polymerase, an expression vector encoding the modified polymerase can be transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection, and the like. Suitable host cells for expressing a polymerase of the disclosure include prokaryote, yeast, or higher eukaryote cells.

Suitable prokaryotes for this purpose include eubacteria, such as Gram-negative or Gram-positive organisms, e.g., Enterobacteriaceae such as *Escherichia*, e.g., *E. coli*, *Enterobacter*, *Erwinia*, *Klebsiella*, *Proteus*, *Salmonella*, e.g., *Salmonella typhimurium*, *Serratia*, e.g., *Serratia marcescans*, and *Shigella*, as well as Bacilli such as *B. subtilis* and *B. licheniformis*, *Pseudomonas* such as *P. aeruginosa*, and *Streptomyces*. In addition to prokaryotes, eukaryotic microbes such as filamentous fungi or yeast are suitable cloning or expression hosts for polypeptide encoding vectors. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe; Kluyveromyces* hosts such as, e.g., *K. lactis, K. fragilis, K. bulgaricus, K. wickeramii, K. waltii, K. drosophilarum, K. thermotolerans,* and *K. marxianus; Pichia pastoris; Candida; Trichoderma reesia; Neurospora crassa; Schwanniomyces* such as *Schwanniomyces occidentalis*; and filamentous fungi such as, e.g., *Neurospora, Penicillium, Tolypocladium,* and *Aspergillus* hosts such as *A. nidulans* and *A. niger.*

In some embodiments, host cells are transformed with the above-described expression or cloning vectors for polymerase production and cultured in conventional nutrient media modified as appropriate for inducing promoters, selecting transformants, or amplifying the genes encoding the desired sequences. The host cells used to produce a polymerase may be cultured in a variety of media. Commercially available media such as Ham's F10™ (Sigma), Minimal Essential Medium™ (MEM), (Sigma), RPMI-1640 (Sigma), and Dulbecco's Modified Eagle's Medium™ (DMEM), (Sigma) are suitable for culturing the host cells. The culture conditions, such as temperature, pH, and the like, are those previously used with the host cell selected for expression, and will be apparent to the ordinarily skilled artisan.

In some embodiments, a polymerase variant can be produced intracellularly, in the periplasmic space, or directly secreted into the medium of a cell. In embodiments where the polymerase variant is produced intracellularly, the particulate debris, either host cells or lysed cells (e.g., resulting from homogenization), can be removed by a variety of means, including but not limited to, by centrifugation or ultrafiltration. Where the polymerase is secreted into the medium, supernatants from such expression systems can be first concentrated using a commercially available protein concentration filter, which can then be subjected to one or more additional purification techniques, including but not limited to affinity chromatography, including protein affinity chromatography, ion exchange chromatography, such as anion or cation exchange chromatography, and hydrophobic interaction chromatography.

In some embodiments, aspects of the present application can be used in methods related to assays of biological samples. In exemplary embodiments, methods provided herein are useful in techniques used to determine the sequence of one or more nucleic acids or polypeptides in the sample and/or to determine the presence or absence of one or more nucleic acid or polypeptide variants (e.g., one or more mutations in a gene of interest) in the sample. In some embodiments, tests can be performed on patient samples (e.g., human patient samples) to provide nucleic acid sequence information or to determine the presence or absence of one or more nucleic acids of interest for diagnostic, prognostic, and/or therapeutic purposes. In some examples, diagnostic tests can include sequencing a nucleic acid molecule in a biological sample of a subject, for example by sequencing cell free DNA molecules and/or expression products (e.g., RNA) in a biological sample of the subject. For example, the present disclosure provides methods and compositions that may be advantageously utilized in the technologies described in co-pending U.S. patent application Ser. Nos. 14/543,865, 14/543,867, 14/543,888, 14/821,656, 14/821,686, 14/821,688, 15/161,067, 15/161,088, 15/161,125, 15/255,245, 15/255,303, 15/255,624, 15/261,697, 15/261,724, 62/289,019, 62/296,546, 62/310,398, 62/339,790, 62/343,997, 62/344,123, and 62/426,144, the contents of each of which are incorporated herein by reference.

Some aspects of the application are useful in techniques capable of sequencing biological polymers, such as nucleic acids and proteins. In some embodiments, methods and compositions described in the application can be used in techniques that identify a series of nucleotide or amino acid monomers that are incorporated into a nucleic acid or protein (e.g., by detecting a time-course of incorporation of a series of labeled nucleotide or amino acid monomers). In some embodiments, methods and compositions described in the application can be incorporated into techniques that identify a series of nucleotides that are incorporated into a template-dependent nucleic acid sequencing reaction product synthesized by a polymerizing enzyme.

During sequencing, a polymerizing enzyme may couple (e.g., attach) to a priming location of a target nucleic acid molecule (e.g., a nucleic acid molecule of a sequencing template). The priming location can comprise a primer that is complementary to a portion of the target nucleic acid molecule. As an alternative the priming location is a gap or nick that is provided within a double stranded segment of the target nucleic acid molecule. A gap or nick can be from 0 to at least 1, 2, 3, 4, 5, 6, 7, 8, 9, 10, 20, 30, or 40 nucleotides in length. A nick can provide a break in one strand of a double stranded sequence, which can provide a priming location for a polymerizing enzyme, such as, for example, a strand displacing polymerase enzyme.

In some cases, a sequencing primer can be annealed to a target nucleic acid molecule that may or may not be immobilized to a solid support. A solid support can comprise, for example, a sample well on an integrated device used for nucleic acid sequencing. In some embodiments, a sequencing primer may be immobilized to a solid support and hybridization of the target nucleic acid molecule also immobilizes the target nucleic acid molecule to the solid support. In some embodiments, a polymerase is immobilized to a solid support and soluble primer and target nucleic acid are contacted to the polymerase. However, in some embodiments a complex comprising a polymerase, a target nucleic acid and a primer is formed in solution and the complex is immobilized to a solid support (e.g., via immobilization of the polymerase, primer, and/or target nucleic acid). In some embodiments, none of the components in a sample well are immobilized to a solid support. For example, in some embodiments, a complex comprising a polymerase, a target nucleic acid, and a primer is formed in solution and the complex is not immobilized to a solid support.

Under appropriate conditions, a polymerase enzyme that is contacted to an annealed primer/target nucleic acid can add or incorporate one or more nucleotides onto the primer, and nucleotides can be added to the primer in a 5' to 3', template-dependent fashion. Such incorporation of nucleotides onto a primer (e.g., via the action of a polymerase) can generally be referred to as a primer extension reaction. Each nucleotide can be associated with a detectable tag that can be detected and identified (e.g., based on its luminescent lifetime and/or other characteristics) during the nucleic acid extension reaction and used to determine each nucleotide incorporated into the extended primer and, thus, a sequence of the newly synthesized nucleic acid molecule. Via sequence complementarity of the newly synthesized nucleic acid molecule, the sequence of the target nucleic acid molecule can also be determined. In some cases, annealing of a sequencing primer to a target nucleic acid molecule and incorporation of nucleotides to the sequencing primer can occur at similar reaction conditions (e.g., the same or similar reaction temperature) or at differing reaction conditions (e.g., different reaction temperatures). In some embodiments, sequencing by synthesis methods can include the presence of a population of target nucleic acid molecules (e.g., copies of a target nucleic acid) and/or a step of amplification of the target nucleic acid to achieve a population of target nucleic acids. However, in some embodiments, sequencing by synthesis is used to determine the sequence of a single molecule in each reaction that is being evaluated (and nucleic acid amplification is not required to prepare the target template for sequencing). In some embodiments, a plurality of single molecule sequencing reactions are performed in parallel (e.g., on a single integrated device) according to aspects of the present application. For example, in some embodiments, a plurality of single molecule sequencing reactions are each performed in separate reaction chambers on an integrated device.

In some embodiments, polymerizing enzymes of the disclosure are useful in single molecule sequencing reactions conducted in sample wells of considerably small volumes. For example, the volume of a sample well may be between about $10^{-21}$ liters and about $10^{-15}$ liters, in some implementations. Because the sample well has a small volume, detection of single-sample events (e.g., single-molecule events) are achievable. In some embodiments, a surface (e.g., a surface of a sample well) is configured to receive a polymerase described herein. In some embodiments, a sample well receives a polymerase that may be disposed on a surface of the sample well, such as a bottom surface. In some embodiments, a sample well is formed within an integrated device, wherein the bottom surface of the sample well is distal to the surface of the integrated device into which it is formed.

In certain embodiments, techniques described herein relate to polymerizing enzymes, and complexes thereof, which may be added to a sample well. In some embodiments, polymerizing enzymes described herein may be confined in a target volume of the sample well (e.g., a reaction volume). In some embodiments, the target volume is a region within a sample well. In embodiments when one or more polymerizing enzymes are to be immobilized on the bottom surface, it may be desirable to functionalize the bottom surface to allow for attachment of the one or more polymerizing enzymes (e.g., polymerizing enzymes and complexes thereof). In some embodiments, the bottom surface is functionalized with a material comprising a coupling group. For example, the coupling group may comprise chemical moieties, such as amine groups, carboxyl groups, hydroxyl groups, sulfhydryl groups, metals, chelators, and the like. Alternatively, they may include specific binding elements, such as biotin, avidin, streptavidin, neutravidin, lectins, SNAP-Tags™ or substrates therefore, associative or binding peptides or proteins, antibodies or antibody fragments, nucleic acids or nucleic acid analogs, or the like. Additionally, or alternatively, the coupling group may be used to couple an additional group that is used to couple or bind with a molecule of interest (e.g., a polymerizing enzyme or complex thereof), which may, in some cases include both chemical functional groups and specific binding elements. By way of example, a coupling group, e.g., biotin, may be deposited upon a substrate surface and selectively activated in a given area. An intermediate binding agent, e.g., streptavidin, may then be coupled to the first coupling group. The molecule of interest (e.g., a polymerizing enzyme or complex thereof), which in this particular example would be biotinylated, is then coupled to the streptavidin. In some embodiments, polymerizing enzymes described herein may further comprises a coupling moiety capable of forming an interaction with a coupling group that immobilizes the polymerase to a surface (e.g., a surface of a sample well). For example, in some embodiments, polymerizing enzymes comprise N-terminal or C-terminal biotinylation sequences capable of binding to an avidin protein. In some embodiments, a biotinylation sequence further comprises linker sequence. For example, in some embodiments, a C-terminal linker/biotinylation sequence comprises the amino acid sequence GGGSGGGSGGGSGLNDFFEAQKIEWHE (SEQ ID NO: 517).

EXAMPLES

Example 1. Expression and Evaluation of Modified Polymerases

Recombinant polymerase variants were expressed in *E. coli* and purified from 150 mL scale cultures using His-spin columns. Protein purity was analyzed by SDS-PAGE followed by Coomassie Blue staining (FIG. 7). Following buffer exchange and protein concentration, the recombinant variants were evaluated for activity and processivity in the presence of dNTPs with trap chase for 30 minutes at 30° C. Chimeric polymerase variants C017 and C020 showed activity, processivity, and length of synthesis in the presence of a trap. Utilization of dNTP analogs by variant polymerases was measured to evaluate suitability of the polymerases in sequencing reactions. Both homologous mutant variants and chimeric polymerase variants displayed utilization of dN6Ps. Results from single molecule sequencing are shown below in Table 6.

TABLE 6

Sequencing Results with Modified Polymerases

| Polymerase (Name) | Num. Reads | Read Length | Rate (bases/s) | Local Base Rate (bases/s) | Pulse Width (s) | Interpulse Dist. (s) | Accuracy |
|---|---|---|---|---|---|---|---|
| Q001 | 90890 | 10205 | 1.82 | 2.41 | 0.07 | 0.36 | 80.9% |
| Q020 | 79366 | 7973 | 1.67 | 2.42 | 0.08 | 0.35 | 81.6% |
| Q035 | 96323 | 15532 | 2.05 | 3.04 | 0.13 | 0.21 | 88.7% |
| Q036 | 104352 | 8816 | 1.26 | 2.03 | 0.09 | 0.42 | 84.5% |
| C0138 | 16742 | 3486 | 1.47 | 2.30 | 0.11 | 0.34 | 71.4% |
| C0145 | 3982 | 6287 | 1.52 | 2.66 | 0.10 | 0.29 | 73.0% |
| C0173 | 3360 | 6125 | 1.59 | 2.52 | 0.11 | 0.30 | 70.0% |
| C0186 | 24165 | 11699 | 1.77 | 2.59 | 0.10 | 0.30 | 73.0% |
| C0189 | 60002 | 2880 | 1.77 | 2.47 | 0.11 | 0.32 | 85.2% |
| C0190 | 8729 | 4938 | 1.15 | 1.67 | 0.33 | 0.29 | 86.0% |

TABLE 6-continued

Sequencing Results with Modified Polymerases

| Polymerase (Name) | Num. Reads | Read Length | Rate (bases/s) | Local Base Rate (bases/s) | Pulse Width (s) | Interpulse Dist. (s) | Accuracy |
|---|---|---|---|---|---|---|---|
| C0239 | 36908 | 11226 | 1.39 | 1.79 | 0.32 | 0.25 | 84.7% |
| C0256 | 17700 | 14200 | 2.21 | 3.18 | 0.11 | 0.22 | 90.3% |
| C0263 | 9440 | 7640 | 1.96 | 2.81 | 0.10 | 0.27 | 84.4% |
| C0266 | 34395 | 10183 | 1.42 | 1.85 | 0.29 | 0.26 | 84.9% |
| C0267 | 811 | 6787 | 1.38 | 1.80 | 0.36 | 0.21 | 88.0% |
| C0268 | 23582 | 6638 | 1.47 | 1.95 | 0.27 | 0.26 | 80.7% |
| C0288 | 40472 | 3763 | 1.22 | 1.77 | 0.33 | 0.24 | 85.0% |
| C0289 | 37754 | 4895 | 1.71 | 2.63 | 0.14 | 0.26 | 85.1% |
| C0290 | 31770 | 4889 | 1.73 | 2.64 | 0.14 | 0.26 | 85.0% |
| C0295 | 36350 | 3110 | 1.48 | 1.99 | 0.21 | 0.31 | 86.1% |
| C0299 | 40027 | 3243 | 1.62 | 2.37 | 0.10 | 0.34 | 83.0% |
| C0303 | 28410 | 5605 | 1.25 | 1.76 | 0.30 | 0.29 | 85.2% |
| C0307 | 23243 | 3013 | 1.31 | 1.93 | 0.23 | 0.30 | 84.3% |
| C0313 | 1890 | 11676 | 1.41 | 1.87 | 0.29 | 0.26 | 81.9% |
| C0320 | 372 | 11679 | 1.53 | 2.09 | 0.27 | 0.22 | 87.5% |
| C0321 | 953 | 12311 | 1.3 | 1.75 | 0.31 | 0.27 | 83.9% |
| C0326 | 23 | 11907 | 2.01 | 2.81 | 0.11 | 0.26 | 77.6% |
| C0327 | 92 | 22355 | 2.12 | 2.93 | 0.09 | 0.27 | 69.5% |
| C0328 | 375 | 12911 | 1.64 | 2.52 | 0.1 | 0.31 | 81% |
| C0329 | 1409 | 19941 | 1.78 | 2.61 | 0.09 | 0.31 | 81.2% |
| C0333 | 828 | 20204 | 1.56 | 2.21 | 0.08 | 0.38 | 76.7% |
| C0334 | 859 | 7597 | 1.19 | 1.8 | 0.32 | 0.26 | 87% |
| C0335 | 664 | 22145 | 2.05 | 3.07 | 0.1 | 0.24 | 83% |
| C0337 | 943 | 16926 | 1.99 | 2.96 | 0.1 | 0.25 | 84% |
| C0338 | 511 | 13170 | 1.37 | 1.86 | 0.3 | 0.25 | 83.8% |
| C0352B | 5269 | 13946 | 1.92 | 2.69 | 0.13 | 0.26 | 84.6% |

EQUIVALENTS AND SCOPE

While several inventive embodiments have been described and illustrated herein, those of ordinary skill in the art will readily envision a variety of other means and/or structures for performing the function and/or obtaining the results and/or one or more of the advantages described herein, and each of such variations and/or modifications is deemed to be within the scope of the inventive embodiments described herein. More generally, those skilled in the art will readily appreciate that all parameters, dimensions, materials, and configurations described herein are meant to be exemplary and that the actual parameters, dimensions, materials, and/or configurations will depend upon the specific application or applications for which the inventive teachings is/are used. Those skilled in the art will recognize, or be able to ascertain using no more than routine experimentation, many equivalents to the specific inventive embodiments described herein. It is, therefore, to be understood that the foregoing embodiments are presented by way of example only and that, within the scope of the appended claims and equivalents thereto, inventive embodiments may be practiced otherwise than as specifically described and claimed. Inventive embodiments of the present disclosure are directed to each individual feature, system, article, material, kit, and/or method described herein. In addition, any combination of two or more such features, systems, articles, materials, kits, and/or methods, if such features, systems, articles, materials, kits, and/or methods are not mutually inconsistent, is included within the inventive scope of the present disclosure.

All definitions, as defined and used herein, should be understood to control over dictionary definitions, definitions in documents incorporated by reference, and/or ordinary meanings of the defined terms.

All references, patents, and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

The phrase "and/or," as used herein in the specification and in the claims, should be understood to mean "either or both" of the elements so conjoined, i.e., elements that are conjunctively present in some cases and disjunctively present in other cases. Multiple elements listed with "and/or" should be construed in the same fashion, i.e., "one or more" of the elements so conjoined. Other elements may optionally be present other than the elements specifically identified by the "and/or" clause, whether related or unrelated to those elements specifically identified. Thus, as a non-limiting example, a reference to "A and/or B", when used in conjunction with open-ended language such as "comprising" can refer, in one embodiment, to A only (optionally including elements other than B); in another embodiment, to B only (optionally including elements other than A); in yet another embodiment, to both A and B (optionally including other elements); etc.

As used herein in the specification and in the claims, "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of," or, when used in the claims, "consisting of," will refer to the inclusion of exactly one element of a number or list of elements. In general, the term "or" as used herein shall only be interpreted as indicating exclusive alternatives (i.e. "one or the other but not both") when preceded by terms of exclusivity, such as "either," "one of," "only one of," or "exactly one of." "Consisting essentially of," when used in the claims, shall have its ordinary meaning as used in the field of patent law.

As used herein in the specification and in the claims, the phrase "at least one," in reference to a list of one or more elements, should be understood to mean at least one element selected from any one or more of the elements in the list of elements, but not necessarily including at least one of each and every element specifically listed within the list of elements and not excluding any combinations of elements in the list of elements. This definition also allows that elements may optionally be present other than the elements specifically identified within the list of elements to which the phrase "at least one" refers, whether related or unrelated to those elements specifically identified. Thus, as a non-limiting example, "at least one of A and B" (or, equivalently, "at least one of A or B," or, equivalently "at least one of A and/or B") can refer, in one embodiment, to at least one, optionally including more than one, A, with no B present (and optionally including elements other than B); in another embodiment, to at least one, optionally including more than one, B, with no A present (and optionally including elements other than A); in yet another embodiment, to at least one, optionally including more than one, A, and at least one, optionally including more than one, B (and optionally including other elements); etc.

It should also be understood that, unless clearly indicated to the contrary, in any methods claimed herein that include more than one step or act, the order of the steps or acts of the method is not necessarily limited to the order in which the steps or acts of the method are recited.

In the claims, as well as in the specification above, all transitional phrases such as "comprising," "including," "carrying," "having," "containing," "involving," "holding," "composed of," and the like are to be understood to be open-ended, i.e., to mean including but not limited to. Only the transitional phrases "consisting of" and "consisting essentially of" shall be closed or semi-closed transitional phrases, respectively, as set forth in the United States Patent Office Manual of Patent Examining Procedures, Section 2111.03. It should be appreciated that embodiments described in this document using an open-ended transitional phrase (e.g., "comprising") are also contemplated, in alternative embodiments, as "consisting of" and "consisting essentially of" the feature described by the open-ended transitional phrase. For example, if the disclosure describes "a composition comprising A and B," the disclosure also contemplates the alternative embodiments "a composition consisting of A and B" and "a composition consisting essentially of A and B."

What is claimed is:

1. A recombinant polymerizing enzyme chimera comprising a majority sequence selected from any one of SEQ ID NOs: 1-4, 6-17, and 19 and one or more segments of SEQ ID NO: 5, wherein the recombinant polymerizing enzyme comprises:
   a) amino acids 445-449 from SEQ ID NO: 5 in place of amino acids corresponding to amino acids 429-433 in SEQ ID NO: 1;
   b) amino acids 271-375 from SEQ ID NO: 5 in place of amino acids corresponding to amino acids 260-359 in SEQ ID NO: 1; and/or
   c) amino acids 72-89 from SEQ ID NO: 5 in place of amino acids corresponding to amino acids 75-91 in SEQ ID NO: 1.

2. The recombinant polymerizing enzyme chimera of claim 1, further comprising an alanine to threonine mutation at a position corresponding to A444 in SEQ ID NO: 1.

3. The recombinant polymerizing enzyme chimera of claim 1, further comprising amino acids 1-51 from SEQ ID NO: 2 in place of amino acids corresponding to amino acids 1-54 of SEQ ID NO: 1.

4. The recombinant polymerizing enzyme chimera of claim 1, wherein one or more amino acid segments of the recombinant polymerizing enzyme chimera comprises a domain of a polymerizing enzyme of Table 1.

5. The recombinant polymerizing enzyme chimera of claim 1, wherein one or more amino acid segments of the recombinant ploymerizing enzyme chimera comprises a portion of a domain of a polymerizing enzyme of Table 1.

6. The recombinant polymerizing enzyme chimera of claim 4, wherein one or more of the amino acid segments of the recombinant polymerizing enzyme chimera comprise one or more amino acids flanking the domain in a polymerizing enzyme of Table 1.

7. The recombinant polymerizing enzyme chimera of claim 1, further comprising at least one amino acid insertion, deletion, or substitution corresponds to an amino acid insertion, deletion, or substitution found in a different naturally-occurring polymerizing enzyme of Table 1.

8. The recombinant polymerizing enzyme chimera of claim 1, further comprising at least one amino acid insertion, deletion, or substitution corresponds to an amino acid insertion, deletion, or substitution that is not found in a naturally-occurring polymerizing enzyme of Table 1.

9. The recombinant polymerizing enzyme chimera of claim 1, comprising two or more corresponding amino acid segments selected from the group consisting of: amino acids 1-51 from SEQ ID NO: 2, amino acids 271-375 from SEQ ID NO: 5, amino acids 72-89 from SEQ ID NO: 5, and amino acids 445-449 from SEQ ID NO: 5.

10. The recombinant polymerizing enzyme chimera of claim 1, comprising at least one amino acid insertion,

SEQUENCE LISTING (539 sequences)

SEQ ID NO: 1 - protein, 575 aa, Bacillus phage phi29 [sequence omitted]

SEQ ID NO: 2 - protein, 572 aa, Bacteriophage M2Y
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDILSTKKFNKVFPKLSLPMDKEIRKAYRGGFTWLNDKYKEKEIGEGMVFDVNSLYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEEGAKKQLAKLMLNSLYGKFASNPDVTGKVPYLKDDGSLGFRVGDEEYKDPVYTPMGVFITAWARFTTITAAQACYDRIIYCDTDSIHLTGTEVPEIIKDIVDPKKLGYWAHESTFKRAKYLRQKTYIQDIYVKEVDGKLKECSPDEATTTKFSVKCAGMTDTIKKKVTFDNFAVGFSSMGKPKPVQVNGGVVLVDSVFTIK

SEQ ID NO: 3 - protein, 830 aa, Lucilia cuprina
MARKRPIRITKNDRAEYKRLSKNAKSKLNRTVKNYGIDLSNDVDIPKLSDFKTRKEFNDWKQKITSFTSRSNQEYQFRKNEYGVVASVKELNEIKRNTKKAQKIAKEKIDKAMKLDFYVEGERQGKVKDRIKLMKKEEVAGVSVPVDFDFDKIQTRKRLEDKAGFMEERATGDYYRKKDIQMKENFISMIEQGFNSDADEVIKKLKKIPPDDFVELTIVTDEIDFRNYGSKNEGGINDEDKLEELNNTLNDYFNETTTDVNDCRVWAYGWMEIGKTSNYKIGTDFNEFMEWMIHSSSRLYFHNLKFDGSFIVNWLLHNGYTWTKRPSKEGQFSTLISKMGQWYGITICSGRDGRKKKLTTIHDSLKKLPFPVRKIGKDFKLNVLKGDIDYHKPRPIGYEIDDEEYQYIKNDIQIIAEALEVQTVQGLTGMTNGKDALDEFVNMSGKLYEKLFPVFSLELNEEIRKAYRGGFTWLNPVYGTKKYVKDGIVFDVNSLYPSQMYDRDLPCGVPIPFEGEYVYDKSHPLYIQKLTFEFELKENYIPTIQLKNSRFGFKGNEYLSSSNGERITISVSSVDWELIREHYHVYDVEFEKGWKFRSTKQAFRQYIDKWMLVKNMSAGAKKAIAKLMLNSLYGKFATNPDITGKRPYLREDGSNGFELMEEEFRDPVYTPVGIFITSWARYTTITSAQKCYDRIIYCDTDSMHLEGLDVPESIKDIVADDVLGYWKKEGQFKQGKFIRQKTYMEEYYAKYVRDENGEIKYDDEKPIKTICDKEESDTTIIEIKCAGMPDNIKKHVTFDNFDIGFTMEGKLKPKQVYGGVVLVEETYTMK

SEQ ID NO: 4 - protein, 589 aa, Lucilia cuprina (mod.)
MKHMPRKMYSCDFETTTDVNDCRVWAYGWMEIGKTSNYKIGTDFNEFMEWMIHSSSRLYFHDLKFDGSFIVNWLLHNGYTWTKRPSKEGQFSTLISKMGQWYGITICSGRDGRKKKLTTIHDSLKKLPFPVRKIGKDFKLNVLKGDIDYHKPRPIGYEIDDEEYQYIKNDIQIIAEALEVQTVQGLTGMTNGKDALDEFVNMSGKLYEKLFPVFSLELNEEIRKAYRGGFTWLNPVYGTKKYVKDGIVFDVNSLYPSQMYDRDLPCGVPIPFEGEYVYDKSHPLYIQKLTFEFELKENYIPTIQLKNSRFGFKGNEYLSSSNGERITISVSSVDWELIREHYHVYDVEFEKGWKFRSTKQAFRQYIDKWMLVKNMSAGAKKAIAKLMLNSLYGKFATNPDITGKRPYLREDGSNGFELMEEEFRDPVYTPVGIFITSWARYTTITSAQKCYDRIIYCDTDSMHLEGLDVPESIKDIVADDVLGYWKKEGQFKQGKFIRQKTYMEEYYAKYVRDENGEIKYDDEKPIKTICDKEESDTTIIEIKCAGMPDNIKKHVTFDNFDIGFTMEGKLKPKQVYGGVVLVEETYTMK

SEQ ID NO: 5 - protein, 573 aa, Enterococcus faecium
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 6 - protein, 592 aa, Bacillus phage VMY22
MATKKRKAYSCDFEATTSTYSETETRVWAYGWMEIGNTSHFNIGDNLDEFMLWTSKECADLYFHDLRYDGEFIVNWLLHKGYECNESGRPKTFDTVISKGGQWYKIAIHHEGKGTTQIFDSLKKLPFPVKTIAKAFKLPVLKGDIDYNLHRDENHVITSEEFTYIKHDIEIVARALDIQINQQGLVKMTNGADSMDHFIKSLDKKKKVAERIYNQYFPKMSIAMDSIFRKAYRGGFTWVNPKFKGQEVGEGMVFDVNSLYPSVMYYKPLPWGKPVPFVGKYEEDPDFPLYICHIKTGFVLKEGHIPTIQIKKNPIFQENEYLETSGGAPVDLHVTNVDLELIKEHYELYDTEYVGGWKFRQQTGIFNNFIDYWMKIKTDPKSTPAIVTLAKLQLNSLYGKFASHPDVTGKVPYLKDDGSTAFKKGLPKSKDPVYTPAGAFITAWARHMTITTAQKVYDRILYCDTDSIHILGIDIPEAIKNDIHQKELGKWAFECMFKRAKFVRQKTYVEDMYAKFMSYWEDGELNYMLKECVKEEATARLLNVKCAGMPQAVKKFVTFRTFAVGFTSDTGKLKPKHVKGGQILVDVPFTIK

SEQ ID NO: 7 - protein, 578 aa, Bacillus phage GA-1
MARSVYVCDFETTTDPEDCRLWAWGWMDIYNTDKWSYGEDIDSFMEWALNSNSDIYFHNLKFDGSFILPWWLRNGYVHTEEDRTNTPKEFTTTISGMGQWYAVDVCINTRGKNKNHVVFYDSLKKLPFKVEQIAKGFGLPVLKGDIDYKKYRPVGYVMDDNEIEYLKHDLLIVALALRSMFDNDFTSMTVGSDALNTYKEMLGVKQWEKYFPVLSLKVNSEIRKAYKGGFTWVNPKYQGETVYGGMVFDVNSMYPAMMKNKLLPYGEPVMFKGEYKKNVEYPLYIQQVRCFFELKKDKIPCIQIKGNARFGQNEYLSTSGDEYVDLYVTNVDWELIKKHYDIFEEEFIGGFMFKGFIGFFDEYIDRFMEIKNSPDSSAEQSLQAKLMLNSLYGKFATNPDITGKVPYLDENGVLKFRKGELKERDPVYTPMGCFITAYARENILSNAQKLYPRFIYADTDSIHVEGLGEVDAIKDVIDPKKLGYWDHEATFQRARYVRQKTYFIETTWKENDKGKLVVCEPQDATKVKPKIACAGMSDAIKERIRFNEFKIGYSTHGSLKPKNVLGGVVLMDYPFAIK

SEQ ID NO: 8 - protein, 566 aa, Actinomyces phage AV-1
MVRQSTIASPARGGVRRSHKKVPSFCADFETTTDEDDCRVWSWGIIQVGKLQNYVDGISLDGFMSHISERASHIYFHNLAFDGTFILDWLLKHGYRWTKENPGVKEFTSLISRMGKYYSITVVFETGFRVEFRDSFKKLPMSVSAIAKAFNLHDQKLEIDYEKPRPIGYIPTEQEKRYQRNDVAIVAQALEVQFAEKMTKLTAGSDSLATYKKMTGKLFIRRFPILSPEIDTEIRKAYRGGFTYADPRYAKKLNGKGSVYDVNSLYPSVMRTALLPYGEPIYSEGAPRTNRPLYIASITFTAKLKPNHIPCIQIKKNLSFNPTQYLEEVKEPTTVVATNIDIELWKKHYDFKIYSWNGTFEFRGSHGFFDTYVDHFMEIKKNSTGGLRQIAKLHLNSLYGKFATNPDITGKHPTLKDNRVSLVMNEPETRDPVYTPMGVFITAYARKKTISAAQDNYETFAYADTDSLHLIGPTTPPDSLWVDPVELGAWKHESSFTKSVYIRAKQYAEEIGGKLDVHIAGMPRNVAATLTLEDMLHGGTWNGKLIPVRVPGGTVLKDTTFTLKID

SEQ ID NO: 9 - protein, 593 aa, Candidatus Moranbacteria
MKLKSKYVADFEATGEEQYKIDGSTHVWAVGVIDIETEETVLISNDIADFMNWLSKDNHNHKNKEVFFHNLKYDGDFIVKFLLENGFKHSRERALYSNEFSTLISDTGTWYEIKICFHALKTRKVEVKIHDSYKLLPFSEEKIAKAFKLTVSKGEIDYDRYRPVGYQLQEYEVDYLKTDLLIMAQALKVQMNKGLTKMTIGSNALADYKQRISKDKFKYLFPVLDNIIDADLRHAYRGGHTYLQPFYANKILENVHSYDKNSMHPSQMKNMPMPYGIPVYYEGEYKNDPDYPLFIQSIEIDCKVKKGYLPTIQPRNAFRFATTEFLEDTKGEPIQLFVTSIDLMLILEHYDIHYIQYLEGFKFRSHIGLFDEYIDYWYHIKETNTGPLREIAKLMLNNLYGKFGTNPIRARKEPIYDKTKGAVYVNLPAEEGDAVYIPMACFITAYSRYDLISTAQKFYKNVVYMDTDSIKFYGISREVIEAQIEVHDTKIGAWKYEGTAKMFKALRPKTYAYIDENDELDVKCAGLPKKAKKDITFDTFQYGFVSKEKLEIKRVKGGTILLKTKFEIKKQVDNKHIDTEYFEDEDIDIFNQL

SEQ ID NO: 10 - protein, 669 aa, Bacillus phage MG-B1
MKKKRTKTKIKTYACDFETNTEAWLHEDKLRDELKTKEENPELWRKREAWKLHTGGDKAFVWSWGGTEIREDMSFKGELDNFVVGKGISEYVDWMLDGSKNVWFHNLKFDGSFIAVELLRRGFKFTFDRNPAIGEFTGLIDGKKMWFELIICKEGKRGGRQFITIKDSLKKVPFGLRVAAMAFGLDVFKDDMDYDVIREPFEPIGEADYKYLKKDVEITAKIIHYQVFQSGLKKTTIGSDALNEFKSTVGGDKGFKEIFPVMDFDTDSFIRKSYFGGVTQVKPGMEGKLIGEGSVFDIVSMYPWVQYTKLLPYGLPIEYNGEYTYDEEYPLYVQQVSFSFVVKDNMLPTIQLKKQNVEFNYNEADDVRKFNGREFQKTSYGEIVTMYVTNVQWEQIQKHYWLDDLHFHKGMMFKGKIGLFKEHIDKWLKVKKQANDDGNDALKSLAKLMLNSPYGKFGTNTIRLNVEPFLWEDDESLGFRVEDDDPPPADPIYTAYASFVTAYAREELVSTIMMCYDRFVYCDTDSIHLIGTEIPEGIKHKIGGDLGDWEPESEFKLAKFHRAKTYCEMVYAKKVMKKDRWGDVVESLKHCSKEEWGTLPQDQKTLDKNLKCAGLQGHLKDYVSFEEFEIGLKINPEVNKDIMGKPLGKLMPCQVKGGTLLKVRKFSLN

SEQ ID NO: 11 - protein, 572 aa, Eggerthella sp.
MNEYISDFETQKDPDTGVMSVWAWSIVDVNDLSNIQYGNNIESWLSAIQGLPNGSLIGFHNLKFDGSYILSYLLGVAKWEYNDKPKARKAKTVECLISSIGVHYNYRINFTKRKYVKIYDTLKIFNMSVSQIAKSFGIKEQKGSIDYAIFRGYNYTMTPKEVEYITNDVKIVAKAIKQFRNEGHERNTIASNAMRYYKKNSYYSNYEFLTYFPHLDDDLYHLLKRAYKGGYCYVNPKFKGKPVGHGRVYDVNSLYPSVMSDPQNKYPIGTPVFFEGKYKDDPIYPLYIQFITAQFELKKGKIPTIQIKNDKRFNPREYVTSTGCLMVNLYLTNVDLEMFYECYNIKEIQYIGGYKFIGRSGIFIDYVNHFKEMKMQATIEKNAGKRSIAKLFLNSLYGKFGASNDKFVKRPYINDKGILAYQTVETPRPAKTVYVPVAAFVTAYARRFIQTLFIKNVDRCCYCDTDSLHLIGDDPPEGVKISDTEFNCMAHESSFSRAKFLGAKLYIEEDEQGNLDVKAAGLGQNEVVKNQITFDNFNTEQEYFGILKSKTVQGGVELSESTFKIRERGTRF

SEQ ID NO: 12 - protein, 568 aa, Streptococcus phage CP-7
MTCYYAGDFETTTNEEETEVWLSCFAKVIDYDKLDTFKVNTSLEDFLKSLYLDLDKTYTETGEDEFIIFFHNLKFDGSFLLSFFLNNDIECTYFINDMGVWYSITLEFPDFTLTFRDSLKILNFSIATMAGLFKMPIAKGTTPLLKHKPDEIKPEWIDYIHVDVAILARGIFAMYYEENFSKYTSASEALTEFKRIFRKSKRKFRDFFPILDEKVDDFCRKAYRGGWTFANPKTQGRTLKQLIDIYDINSMYPATMLQNALPIGIPKRYKGKPKEIKEDHYYIYHIKADFDLKRGYLPTIQIKKKLDALRIGVRTSDYVTTSKNEVIDLYLTNFDLDLFLKHYDATIMYVETLEFQTESGLFDDYITTYRYKKENAQSPAEKQKAKIMLNSLYGKFGAKIISVKKLAYLDDKGILRFKNDDEEEVQPVYAPVALFVTSIARHFIISNAQENYDNFLYADTDSLHLFHSDSLVLDIDPSEFGKWAHEGRAVKAKYLRSKLYIEELIQEDGTTHLDVKGAGMTPEIKEKITFENFVIGATFEGKRASKQIKGGTLIYETTFKIRETDYLV

SEQ ID NO: 13 - protein, 616 aa, Bacteroides sp.
MSKKSAKKPVIIAADFETTVYPGQTSTEVWSAAWIELFTERPHVRGNIEDFLNDIFNLNKNVLCYFHNLRFDGAFIVYWLLKNGYTWNNARNKGMNAKEFKALISDTNKWYTVTVKPKFDTVIEFRDSVKLMPMTLDQIGSAFNTKHRKLEMEYIGMRHANCEITPEEYAYIINDIYVLKEALEVMIKSGHDKLTIGSCCMDEFKNKFDAMDFKAAFPNLKEIALIKYELGSDNVDQYIRKAYKGGYCYYKYKQRKHITQNGMTFDVNSLYPSVMHSKSGNYYPTGKPIFFEKAIPYKCLEARVYPFYVRLRCRFKLKDGFLPTVQIKGDYKYNSTQWLETSDIYYRGKYYRYFTNKEGQKEEARPELTLFMTDYLLLLEHYDVYDLEILDGCYFHGAIGLFDTYIDHYMKIKMTTKDKGERTEAKLFLNNLYGRLAINDNSSYREPFIDPETDSIGFELHPEHEKDTLYIAAGAAVTAYARYFTITHAQANYQNFVYSDTDSIHMLDDGQPVKMIKEHATELLHWKRESDWSSAIFIRQKTYAEFVQKEDGKKVTGHWEIKCAGMPEKSKKLFLASHPITDFKIGLKVGGKLKPKYISGGMVLVEDFYTLRAKRC

SEQ ID NO: 14 - protein, 641 aa, Chlamydia trachomatis
MKARKFKIYAADFETTVFKGQTFTEVWSACFCELYKKDAKIMHSIQDFFNYFFSLNENIKMYFHNLKFDGSFILSYLLKDLKYEQAYEKMNADGSLVRWLETKDMKNNSIKYSISEMGQWYYIIIKKNNKIIEIRDSLKLLPFSLEAIGKSFDTEHKKLKMKYEGYRYAGCEITPEEQAYIKNDVLVLKEALEIMFNEKHESLTIGSCCLNEYKTIMTKFLIERLYPNIAEYTVNVPLEFKNADEYVRKSYKGGWCYLKKGCENKIYNNGTTADVNSLYSSVMHSESGNYYPVGLPTFWSGNYIPEIAKEKYYFIRIKTRFYLKKRFLPCIQVKNTYRYKSTEWLETSDFYDKKTNKYYKKYLDINGNEQNTQVILTLTMTDFELIKEHYNLVDFEILDGCYFDKEIGLFDEYINKYKKIKLNSKGAKKTLAKLYLNNLYGKTATNTDSSFKVAYIKDDLSLGFYGVYACDKKPFYIPVGSAITSYARNFTIRAAQKNYKNFIYADTDSIHCKCNPAEIKGITIDDKKFLCWKLESCWDKGLFVRQKTYIEHITAENLKPIDKPFYNVKCAGMPEQCKTLFLKSIGEDVDISDLNINDDAKEFLKKKRTIKDFKAGLSVPLKLRPVQINGGVLLTETFYTM

SEQ ID NO: 15 - protein, 574 aa, Globodera pallida
MPLPRKKASSNGLSKRIYLADFETTTQAEDCRVWSWGLCSVENTENVEFGGDLDSFIERISEENSITFFHNLKFDGAFILDRLFRLGYEFTDEKAPQVKEFSTLISKMGQFYSIKVRWENGMFTEFRDSLKKLPMSVKQVAKTFKLDQAKGEIDYHYLRPVGWVMTPEEREYVKNDVQIVARALKVQLQEGMTRLTVGADSLAQYKSMMGKDFERHFPVLTRTIDAEIRRAYRGGWAYADERHRGKVVGAGQTFDVNSLYPSVMYSKVLPYGEPVFYPNGLPEVTEDHPLFITCITFTAKIRDGHLPCIQIKNSSLFTPTEYVKEVLDPITMYCTNVDLELWQEHYDMDILAYNGAWLFRGIRGFFNDYIDHWMRIKEESEGGRKLIAKLHLNSLYGKFATNPDVTPKIPIFDEEKDIVRLIEGPPDERNPVYTAMGVFITSYARDLTIRTAQDHYDRFLYADTDSLHLLTSDGTNNGRKSKALEVHPSKLGYWKHEYDFDAGLFVRAKAYTELMTGEFHVKSKCECDTPNDLHYQTHIAGMPEAIAQHITFESYRDGATFEGKLAPQRVPGGI

SEQ ID NO: 16 - protein, 584 aa, Globodera sp.
MPLPRKKASSNGLSKRIYLADFETTTQAEDCRVWSWGLCSVENTENVEFGGDLDSFIERISEENSITFFHNLKFDGAFILDRLFRLGYEFTDEKAPQVKEFSTLISKMGQFYSIKVRWENGMFTEFRDSLKKLPMSVKQVAKTFKLDQAKGEIDYHYLRPVGWVMTPEEREYVKNDVQIVARALKVQLQEGMTRLTVGADSLAQYKSMMGKDFERHFPVLTRTIDAEIRRAYRGGWAYADERHRGKVVGAGQTFDVNSLYPSVMYSKVLPYGEPVFYPNGLPEVTEDHPLFITCITFTAKIRDGHLPCIQIKNSSLFTPTEYVKEVLDPITMYCTNVDLELWQEHYDMDILAYNGAWLFRGIRGFFNDYIDHWMRIKEESEGGRKLIAKLHLNSLYGKFATNPDVTPKIPIFDEEKDIVRLIEGPPDERNPVYTAMGVFITSYARDLTIRTAQDHYDRFLYADTDSLHLLTSDGTNNGRKSKALEVHPSKLGYWKHEYDFDAGLFVRAKAYTELMTGEFHVKSKCECDTPNDLHYQTHIAGMPEAIAQHITFESYRDGATFEGKLAPQRVPGGIVLVDDTFTIK

SEQ ID NO: 17 - protein, 548 aa, Lynx pardinus
  misc_feature (339)..(374): Xaa can be any naturally occurring amino acid
MPSYTADFETTTVADDCRVWAWATSRIGNPDDVQLGNSIDTFLEWCRVHSGSRVYFHNLKFDGKFILHKILTDGWKWIPDKNDCANRTFTTLISDMSQFYSIKLWFDESKSIEFLDSLKVIPLPIAAIPKAFGLEIEKLDLDYQASREVGHELTEDEKEYIAHDVKIAAMAMDTMFSQGMKKITAGSNAFADYKKTIGGKKRFRDWFPEPEYDEDLRKGGCYKGGFTAVNPKIAGKKLGKGVSFDVNSLYPSVMASSHGEVLPYGEPIPYDGGYEQDEDHPLYIQFIEADFAVKENRIPCLQLKGNVMFGETEYIRDSKGMQTLCLTSVDMEMLFEHYXXXXXXXXXXXXXXXXXXXXXXXXXXXXXXXXXXXXRTIAKLQLNSLFAANPVKQSRMPYLDEGIVKYALLEPEHAEAQYLPAGAFITSYARQFTIRAAQANYERWLYCDTDSVYLRGTEPPVDMRVDAYELGAWKKEHEFDCFKAIRAKTYCFEEDGELTVHCAGMPARCHEHVTMDNFEVGASFPGKLKPKDVNGGTILVEDVFTIRP

SEQ ID NO: 18 - protein, 611 aa, Enterococcus faecium (SK)
MIKKYTGDFETTTDLNDCRVWSWGVCDIDNVDNITFGLDIDSFFEWCEMQGSTDIYFHNEKFDGEFMLSWLFKNGFKWSKETKEERTFSTLISNMGQWYALEICWEVNYTTTKSGKTKKEKVRTIIYDSLKKYPFPVKQIAEAFNFPIKKGEIDYTKERPVGYNPTDDEWDYLKNDIQIMAMALKIQFDQGLTRMTRGSDALGDYKDWLKATHGKSTFKQWFPILSLGFDKDLRKAYKGGFTWVNKVFQGKEIGDGIVFDVNSLYPSQMYVRPLPYGTPLFYEGEYKPNNDYPLYIQNIKVRFRLKEGYIPTIQVKQSSLFIQNEYLDSSVNKLGVDELIDLTLTNVDLELFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDRIIYCDTDSIHLVGTDVPEAIEHLVDPKKLGYWGHESTFQRAKFIRQKTYVEEIDGELNVKCAGMPDRIKELVTFDNFEVGFSSYGKLLPKRTQGGVVLVDTMFTIKGHHHHHHHHHHGGGSGGGSGGGSGLNDFFEAQKIEWHE

SEQ ID NO: 19 - protein, 646 aa, Bacillus phage Harambe
MGNKKRKIYSCDFETTTDVNDCRVWAYGLMEIDGKFENYKEGNNIDEFMEWTEQEQGDLYFHNLRFDGEFIVNWLLHKGYRFNNTRKAGTFNAVISSMGQWYKIDIYYGREGKKVFKTSIYDSLKKLPFPVKTIAKAFKLPIEKGDIDYDAPRPVGHQITPDESKYIKNDVEIIARALHSQLNTAKLTKMTIGSDALDGFKHSLHKSPKVSKRMYDHHFPVISNAIHEEFKKAYRGGFTWANPKYAGKVIGNGLVFDVNSLYPSVMYDKPLPYGLPVPFSGEYEYDETHPLFIQHIKCGFELKDGHIPTIQIKKNFRFADNEYLHSSEGNILDLHVTNVDLALIKEHYTLYEEEYLQGYKFKQVTGLFKNYIDYWSDKKINAEDPAIRQMAKLMLNSLYGKFGTSIDVTGKEVFLKEDGSTGFRKGQKEERDPVYMPMGAFITAYARDVTIRTAQKCYDRILYCDTDSIHLVGTEIPEAIKDRIHDKKLGYWAHESTFWRAKFIRQKTYIEDLCMRFEGEKVNGEWKFKMVEEKDITKATARELSVKCAGMPAQVKQYVTFDNFGVDFKHDPNDYTDEEIKRKNIKFKLKPTHRKGGQVLVPTPFTIKGHHHHHHHHHHGGGSGGGSGGGSGLNDFFEAQKIEWHE

SEQ ID NO: 20 - protein, 572 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLEQHGFKWSNEGLPNTYNTIISKMGQWYMIDICFGYKGKRKLHTVIYDSLKKLPFPVKKIAKDFQLPLLKGDIDIHTERPVGHEITPEEYEYIKNDIEIIARALDIQFKQGLDRMTAGSDSLKGFKDILSTKKFNKVFPKLSLPMDKEIRKAYRGGFTWLNDKYKEKEIGEGMVFDVNSLYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEEGAKKQLAKLMLNSLYGKFASNPDVTGKVPYLKDDGSLGFRVGDEEYKDPVYTPMGVFITAWARFTTITAAQACYDRIIYCDTDSIHLTGTEVPEIIKDIVDPKKLGYWEHESTFKRAKYLRQKTYIQDIYVKEVDGKLKECSPDEATTTKFSVKCAGMTDTIKKKVTFDNFAVGFSSMGKPKPVQVNGGVVLVDSVFTIK

SEQ ID NO: 21 - protein, 572 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLEQHGFKWSNEGLPNTYNTIISKMGQWYMIDICFGYKGKRKLHTVIYDSLKKLPFPVKKIAKDFQLPLLKGDIDIHTERPVGHEITPEEYEYIKNDIEIIARALDIQFKQGLDRMTAGSDSLKGFKDILSTKKFNKVFPKLSLPMDKEIRKAYRGGFTWLNDKYKEKEIGEGMVFDANSAYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEEGAKKQLAKLMLNSLYGKFASNPDVTGKVPYLKDDGSLGFRVGDEEYKDPVYTPMGVFITAWARFTTITAAQACYDRIIYCDTDSIHLTGTEVPEIIKDIVDPKKLGYWEHESTFKRAKYLRQKTYIQDIYVKEVDGKLKECSPDEATTTKFSVKCAGMTDTIKKKVTFDNFAVGFSSMGKPKPVQVNGGVVLVDSVFTIK

SEQ ID NO: 22 - protein, 572 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLEQHGFKWSNEGLPNTYNTIISKMGQWYMIDICFGYKGKRKLHTVIYDSLKKLPFPVKKIAKDFQLPLLKGDIDIHTERPVGHEITPEEYEYIKNDIEIIARALDIQFKQGLDRMTAGSDSLKGFKDILSTKKFNKVFPKLSLPMDKEIRKAYRGGFTWLNDKYKEKEIGEGMVFDANSAYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEYGAKKQLAKLMLNSLYGKFASNPDVTGKVPYLKDDGSLGFRVGDEEYKDPVYTPMGVFITAWARFTTITAAQACYDRIIYCDTDSIHLTGTEVPEIIKDIVDPKKLGYWEHESTFKRAKYLRQKTYIQDIYVKEVDGYLKECSPDEATTTKFSVKCAGMTDTIKKKVTFDNFAVGFSSMGKPKPVQVNGGVVLVDSVFTIK

SEQ ID NO: 23 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDILSTKKFNKVFPKLSLPMDKEIRKAYRGGFTWLNDKYKEKEIGEGMVFDANSAYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEYGAKKQLAKLMLNSLYGKFASNPDVTGKVPYLKDDGSLGFRVGDEEYKDPVYTPMGVFITAWARFTTITAAQACYDRIIYCDTDSIHLTGTEVPEIIKDIVDPKKLGYWEHESTFKRAKYLRQKTYIQDIYVKEVDGYLKECSPDEATTTKFSVKCAGMTDTIKKKVTFDNFAVGFSSMGKPKPVQVNGGVVLVDSVFTIK

SEQ ID NO: 24 - protein, 573 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 25 - protein, 573 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 26 - protein, 573 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 27 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDIHTERPVGHEITPEEYEYIKNDIEIIARALDIQFKQGLDRMTAGSDSLKGFKDILSTKKFNKVFPKLSLPMDKEIRKAYRGGFTWLNDKYKGKEIGEGMVFDINSAYPSQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYVKTHEYGAKKQLAKLMLNSLYGKFASNPDVTGKVPYLKDDGSLGFRVGDEEYKDPVYTPMGVFITAWGRFTTITAAQACYDRIIYCDTDSIHLTGTEVPEIIKDIVDPKKLGYWEHESTFKRAKYLRQKTYIQDIYVKEVKGYLKQCSPDEATTTKFSVKCAGMTDTIKKKVTFDNFAVGFSSMGKPKPVQVNGGVVLVDSVFTIK

SEQ ID NO: 28 - protein, 589 aa, Artificial sequence
  Synthetic polypeptide
MKHMPRKMYSCDFETTTDVNDCRVWAYGWMEIGKTSNYKIGTDFNEFMEWMIHSSSRLYFHDLKFDGSFIVNWLLHNGYTWTKRPSKEGQFSTLISKMGQWYGITICSGRDGRKKKLTTIHDSLKKLPFPVRKIGKDFKLNVLKGDIDIHKPRPIGYEIDDEEYQYIKNDIQIIAEALEVQTVQGLTGMTNGKDALDEFVNMSGKLYEKLFPVFSLELNEEIRKAYRGGFTWLNPVYGGKKYVKDGIVFDANSAYPSQMYDRDLPCGVPIPFEGEYVYDKSHPLYIQKLTFEFELKENYIPTIQLKNSRFGFKGNEYLSSSNGERITISVSSVDWELIREHYHVYDVEFEKGWKFRSTKQAFRQYIDKWMLVKNMSYGAKKAIAKLMLNSLYGKFATNPDITGKRPYLREDGSNGFELMEEEFRDPVYTPVGIFITSWARYTTITSAQKCYDRIIYCDTDSMHLEGLDVPESIKDIVADDVLGYWEKEGQFKQGKFIRQKTYMEEYYAKYVRDENGEIKYDDEKPYKTICDKEESDTTIIEIKCAGMPDNIKKHVTFDNFDIGFTMEGKLKPKQVYGGVVLVEETYTMK

SEQ ID NO: 29 - protein, 573 aa, Artificial sequence
  Synthetic polypeptide
MIKKYTGDFETTTDLNDCRVWSWGVCDIDNVDNITFGLEIDSFFEWCEMQGSTDIYFHDEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 30 - protein, 592 aa, Artificial sequence
  Synthetic polypeptide
MATKKRKAYSCDFEATTSTYSETETRVWAYGWMEIGNTSHFNIGDNLDEFMLWTSKECADLYFHDLRYDGEFIVNWLLHKGYECNESGRPKTFDTVISKGGQWYKIAIHHEGKGTTQIFDSLKKLPFPVKTIAKAFKLPVLKGDIDINLHRDENHVITSEEFTYIKHDIEIVARALDIQINQQGLVKMTNGADSMDHFIKSLDKKKKVAERIYNQYFPKMSIAMDSIFRKAYRGGFTWVNPKFKGQEVGEGMVFDANSAYPSVMYYKPLPWGKPVPFVGKYEEDPDFPLYICHIKTGFVLKEGHIPTIQIKKNPIFQENEYLETSGGAPVDLHVTNVDLELIKEHYELYDTEYVGGWKFRQQTGIFNNFIDYWMKIKTDPKSTPAIVTLAKLQLNSLYGKFASHPDVTGKVPYLKDDGSTAFKKGLPKSKDPVYTPAGAFITAWARHMTITTAQKVYDRILYCDTDSIHILGIDIPEAIKNDIHQKELGKWEFECMFKRAKFVRQKTYVEDMYAKFMKYWEDGELNYYLKECVKEEATARLLNVKCAGMPQAVKKFVTFRTFAVGFTSDTGKLKPKHVKGGQILVDVPFTIK

SEQ ID NO: 31 - protein, 573 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 32 - protein, 573 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 33 - protein, 573 aa, Artificial sequence; identical to SEQ ID NO: 24
  Synthetic polypeptide

SEQ ID NO: 34 - protein, 573 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 35 - protein, 573 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSAYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 36 - protein, 573 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIDGELNVKCAGMPDRIKELVTFDNFEVGFSSYGKLLPKRTQGGVVLVDTMFTIK

SEQ ID NO: 37 - protein, 573 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 38 - protein, 573 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWTEVKTTTYGARKQLAKLMLNSLYGKFGTNPDITGKVPYMGEDGIVRLTLGEEELRDPVYVPLASFVTAWGRYTTITTAQRCFDNIIYCDTDSIHLTGTEVPEAIEHLVDPKKLGYWEHESTFKRAKFIRQKTYVEEIDGELNVKCAGMPDRIKELVTFDNFEVGFSSYGKLLPKRTQGGVVLVDTMFTIK

SEQ ID NO: 39 - protein, 573 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTYGARKQNAKLMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWEHESTFQRAKFIRQKTYVEEIDGELNVKCAGMPDRIKELVTFDNFEVGFSSYGKLLPKRTQGGVVLVDTMFTIK

SEQ ID NO: 40 - protein, 591 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDITKERPIGYNPTDDEWDYLKNDIQIMAMALKIQFDQGLTRMTRGSDALGDYQDWVKTTYGKSRFKQWFPVLSLGFDKDLRKAYKGGFTWVNKVFQGKEIGEGIVFDVNSLYPSQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDNIIYCDTDSIHLTGTEVPEAIEHLVDSKKLGYWKHESTFQRAKFIRQKTYVEEIYMKRVKGYLVQGSPDDYTDGELNVKCAGMPDRIKELVTFDNFEVGFSSYGKLLPKRTQGGVVLVDTMFTIK

SEQ ID NO: 41 - protein, 611 aa, Artificial sequence
  Synthetic polypeptide
MIKKYTGDFETTTDLNDCRVWSWGVCDIDNVDNITFGLDIDSFFEWCEMQGSTDIYFHNEKFDGEFMLSWLFKNGFKWSKETKEERTFSTLISNMGQWYALEICWEVNYTTTKSGKTKKEKVRTIIYDSLKKYPFPVKQIAEAFNFPIKKGEIDITKERPVGYNPTDDEWDYLKNDIQIMAMALKIQFDQGLTRMTRGSDALGDYKDWLKATHGKSTFKQWFPILSLGFDKDLRKAYKGGFTWVNKVFQGKEIGDGIVFDVNSLYPSQMYVRPLPYGTPLFYEGEYKPNNDYPLYIQNIKVRFRLKEGYIPTIQVKQSSLFIQNEYLDSSVNKLGVDELIDLTLTNVDLELFFEHYDILEIHYTYGYMFKASCDMFKGWIDKWIEVKNTTEGARKANAKGMLNSLYGKFGTNPDITGKVPYMGEDGIVRLTLGEEELRDPVYVPLASFVTAWGRYTTITTAQRCFDRIIYCDTDSIHLVGTDVPEAIEHLVDPKKLGYWGHESTFQRAKFIRQKTYVEEIDGELNVKCAGMPDRIKELVTFDNFEVGFSSYGKLLPKRTQGGVVLVDTMFTIKGHHHHHHHHHHGGGSGGGSGGGSGLNDFFEAQKIEWHE

SEQ ID NO: 42 - protein, 613 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 43 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 44 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSKGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 45 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGKLVQGSPDDYTDIKFSVKCAGMTDKIKKEVTFENFKVGFSRKMKPKPVQVPGGVVLVDETFTIK

SEQ ID NO: 46 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWCHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 47 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIRQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 48 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKRLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 49 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDARSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 50 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDDKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 51 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 52 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPDKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 53 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAFRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 54 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWEHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 55 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWCHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 56 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWSHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 57 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWTHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 58 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWNHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 59 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDYHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSLYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSEGAIKQLAKLMLNSLYGKFASNPDVTGKVPYLKENGALGFRLGEEETKDPVYTPMGVFITAWARYTTITAAQACYDRIIYCDTDSIHLTGTEIPDVIKDIVDPKKLGYWQHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 60 - protein, 575 aa, Artificial sequence [sequence omitted]

SEQ ID NO: 61 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGKLVQGSPDDYTDIKFSVKCAGMTDKIKKEVTFENFKVGFSRKMKPKPVQVPGGVVLVDETFTIK

SEQ ID NO: 62 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWNHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 63 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWQHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 64 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKFGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 65 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMKSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 66 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPSQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 67 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKDTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 68 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAWKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 69 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQWAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 70 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLFLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 71 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKAFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 72 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTRSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 73 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWDYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKKGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 74 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWEYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKKGYWAHASTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 75 - protein, 613 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSAYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 76 - protein, 613 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIKGHHHHHHHHHHGGGSGGGSGGGSGLNDFFEAQKIEWHE

SEQ ID NO: 77 - protein, 613 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 78 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGKLVQGSPDDYTDIKFSVKCAGMTDKIKKEVTFENFKVGFSRKMKPKPVQVPGGVVLVDETFTIK

SEQ ID NO: 79 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGKLVEGSPDDYTDIKFSVKCAGMTDKIKKEVTFENFKVGFSRKMKPKPVQVPGGVVLVDETFTIK

SEQ ID NO: 80 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKEVDGKLVQGSPDDYTDIKFSVKCAGMTDKIKKEVTFENFKVGFSRKMKPKPVQVPGGVVLVDETFTIK

SEQ ID NO: 81 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDETFTIK

SEQ ID NO: 82 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDETFTIK

SEQ ID NO: 83 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKEVDGKLVEGSPDDYTDIKFSVKCAGMTDKIKKEVTFENFKVGFSRKMKPKPVQVPGGVVLVDDTFTIK

SEQ ID NO: 84 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKHVDGKLVEGSPDDYTKIKFSVKCAGMTDKIKKEVTFENFKVGFSRKMKPKPVQVPGGVVLVDDTFTIK

SEQ ID NO: 85 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKHVHGKLVEGSPDDYTKIKFSVKCAGMTDKIKKEVTFENFKVGFSRKMKPKPVQVPGGVVLVDDTFTIK

SEQ ID NO: 86 - protein, 575 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTVLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKEVDGKLVEGSPDDYTDIKLSVKCAGMTDKIKKEVTFENFKVGFSRKMKPKPVQVPGGVVLVDDTFTIK

SEQ ID NO: 87 - protein, 575 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVDGKLVEGSPDDYTKIKLSVKCAGMTDKIKKEVTFENFKVGFSRKMKPKPVQVPGGVVLVDDTFTIK

SEQ ID NO: 88 - protein, 575 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVHGKLVEGSPDDYTKIKLSVKCAGMTDKIKKEVTFENFKVGFSRKMKPKPVQVPGGVVLVDDTFTIK

SEQ ID NO: 89 - protein, 575 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKNVNGKLVEGSPDDYTKIKLSVKCAGMTDKIKKEVTFENFKVGFSRKMKPKPVQVPGGVVLVDDTFTIK

SEQ ID NO: 90 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVHGKLVEGSPDDYTKIKLSVKCAGMTDKIKKEVTFENFKVGFSRKMKPKPVQVPGGVVLVDDTFTIK

SEQ ID NO: 91 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKNVNGKLVEGSPDDYTKIKLSVKCAGMTDKIKKEVTFENFKVGFSRKMKPKPVQVPGGVVLVDDTFTIK

SEQ ID NO: 92 - protein, 575 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVDGKLVEGSPDDYTKIKLSVKCAGMTDKIKKEVTFENFKVGFSRKMKPKPVQVPGGVVLVDDTFTIK

SEQ ID NO: 93 - protein, 575 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVHGKLVEGSPDDYTKIKLSVKCAGMTDKIKKEVTFENFKVGFSRKMKPKPVQVPGGVVLVDDTFTIK

SEQ ID NO: 94 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKHVDGKLVEGSPDDYTKIKFSVKCAGMTDKIKKEVTFENFKVGFSRKMKPKPVQVPGGVVLVDDTFTIK

SEQ ID NO: 95 - protein, 575 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVHGKLVNGSPDDYTKIKLSVKCAGMTDKIKKEVTFENFKVGFSRKMKPKPVQVPGGVVLVDDTFTIK

SEQ ID NO: 96 - protein, 575 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAKDFKLTKLKGDIDIHKERPVGYKITPEEYAYIKNDIQIIAEALLIQFKQGLDRMTAGSDSLKGFKDIITTKKFKKVFPTLSLGLDKEVRYAYRGGFTWLNDRFKEKEIGEGMVFDVNSHYPAQMYSRLLPYGEPIVFEGKYVWDEDYPLHIQHIRCEFELKEGYIPTIQIKNSRFYKGNEYLKSSGGEIADLWLSNVDLELMKEHYDLYNVEYISGLKFKATTGLFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRPKTYIQDIYMKHVDGKLVNGSPDDYTKIKLSVKCAGMTDKIKKEVTFENFKVGFSRKMKPKPVQVPGGVVLVDDTFTIK

SEQ ID NO: 97 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEQYPLYIQRIRFEFELKEGYIPTIQIKKNPFFKGNEYLKNSGVEPVELYLTNVDLELIQEHYELYNVEYIDGFKFRETTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 98 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKKNPFFKGNEYLKNSGVEPVELYLTNVDLELIQEHYELYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 99 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKKNPFFKGNEYLKNSGVEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 100 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRILPYGDPIVFDGKYVWDDEYPLHIQHIRCEFELKDGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 101 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRILPYGDPIVFDGKYVWDDEYPLHIQHIRCDFELKDGYIPTIQIKRSRFYKGNEYLKSSGGDLVELWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 102 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRILPYGDPIVFDGKYVWDDEYPLHIQHIRCDFELKDGYIPTIQIKRSRFYKGNEYLKSSGGDLVELWISQVDIDLMKEHYELYNVEYLSGIKFRATTGIFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 103 - protein, 572 aa, Artificial sequence
  Synthetic polypeptide
MSRKMFSCDFETTTRLDDCRVWAYGYMEIGNLDNYKLGNSLDEFMQWVMEINADLYFHDLKFDGAFLVNWLEQHGFRWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 104 - protein, 572 aa, Artificial sequence
  Synthetic polypeptide
MSRKMFSCDFETTTRLDDCRVWAYGYMEIGNLDNYKLGNSLDEFMQWVMEINADLYFHDLKFDGAFLVNWLEQHGFRWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRILPYGDPIVFDGKYVWDDEYPLHIQHIRCDFELKDGYIPTIQIKRSRFYKGNEYLKSSGGDLVELWISQVDIDLMKEHYELYNVEYLSGIKFRATTGIFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 105 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRILPYGDPIVFDGKYVWDDEYPLHIQHIRCDFELKDGYIPTIQIKRSRFYKGNEYLKSSGGELVELYVTNIDLDLIKEHYELYNVEYLSGLKFRATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 106 - protein, 572 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 107 - protein, 582 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 108 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 109 - protein, 580 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 110 - protein, 572 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 111 - protein, 587 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 112 - protein, 572 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 113 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 114 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 115 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 116 - protein, 576 aa, Artificial sequence
  Synthetic polypeptide
MKHMPRKMYSCDFETTTDVNDCRVWAYGWMEIGKTSNYKIGTDFNEFMEWMIHSSSRLYFHDLKFDGSFIVNWLLHNGYTWTKRPSKEGQFSTLISKMGQWYGITICSGRDGRKKKLTTIHDSLKKLPFPVRKIGKDFKLNVLKGDIDYHKPRPIGYEIDDEEYQYIKNDIQIIAEALEVQTVQGLTGMTNGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 117 - protein, 576 aa, Artificial sequence
  Synthetic polypeptide
MKHMPRKMYSCDFETTTKVEDCRVWAYGYMNIEDHSEYKIGNSLDEFMAWVLKVQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYDRDLPCGVPIPFEGEYVYDKSHPLYIQKLTFEFELKENYIPTIQLKNSRFGFKGNEYLSSSNGERITISVSSVDWELIREHYHVYDVEFEKGWKFRSTKQAFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 118 - protein, 577 aa, Artificial sequence
  Synthetic polypeptide
MKHMPRKMYSCDFETTTDVNDCRVWAYGWMEIGKTSNYKIGTDFNEFMEWMIHSSSRLYFHDLKFDGSFIVNWLLHNGYTWTKRPSKEGQFSTLISKMGQWYGITICSGRDGRKKKLTTIHDSLKKLPFPVRKIGKDFKLNVLKGDIDYHKPRPIGYEIDDEEYQYIKNDIQIIAEALEVQTVQGLTGMTNGSDSLKGFKDIITTKKFKKVFPTLSLGLDKEVRKAYRGGFTWLNDRFKGKEIGEGMVFDANSHYPAQMYDRDLPCGVPIPFEGEYVYDKSHPLYIQKLTFEFELKENYIPTIQLKNSRFGFKGNEYLSSSNGERITISVSSVDWELIREHYHVYDVEFEKGWKFRSTKQAFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 119 - protein, 575 aa, Artificial sequence; identical to SEQ ID NO: 53
  Synthetic polypeptide

SEQ ID NO: 120 - protein, 582 aa, Artificial sequence
  Synthetic polypeptide
MIKKYTGDFETTTDLNDCRVWSWGVCDIDNVDNITFGLEIDSFFEWCEMQGSTDIYFHNEKFDGEFMLSWLFKNGFKWCKEAKEERTFSTLISNMGQWYALEICWNVKCTTTKTGKTKKEKQRTIIYDSLKKYPFPVKEIAEAFNFPIKKGEIDYTKERPIGYNPTDDEWDYLKNDIQIMAMALKIQFDQGLTRMTRGSDALGDFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 121 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEVPEAIEHLVDSKKLGYWEHESTFQRAKFIRQKTYIQDIYMKRVKGYLVQGSPDDYTDIKFSVKCAGMTDKIKKEVTFENFKVGFSRKMKPKPVQVPGGVVLVDETFTIK

SEQ ID NO: 122 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEVPEAIEHLVDPKKLGYWEHESTFQRAKFIRQKTYIQDIYMKRVKGYLVQGSPDDYTDIKFSVKCAGMTDKIKKEVTFENFKVGFSRKMKPKPVQVPGGVVLVDETFTIK

SEQ ID NO: 123 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYVKKVRGYLVQCSPDEATTTKFSVKCAGMTDKIKKEVTFENFKVGFSRKMKPKPVQVPGGVVLVDETFTIK

SEQ ID NO: 124 - protein, 572 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEVPEAIEHLVDPKKLGYWEHESTFQRAKFIRQKTYIQDIYVKKVRGYLVQCSPDEATTTKFSVKCAGMTDKIKKEVTFENFKVGFSRKMKPKPVQVPGGVVLVDETFTIK

SEQ ID NO: 125 - protein, 572 aa, Artificial sequence
  Synthetic polypeptide
MIKKYTGDFETTTDLNDCRVWSWGVCDIDNVDNITFGLEIDSFFEWCEMQGSTDLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 126 - protein, 577 aa, Artificial sequence
  Synthetic polypeptide
MIKKYTGDFETTTDLNDCRVWSWGVCDIDNVDNITFGLEIDSFFEWCEMQGSTDIYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 127 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 128 - protein, 596 aa, Artificial sequence
  Synthetic polypeptide
MVRQSTIASPARGGVRRSHKKVPSFCADFETTTDEDDCRVWSWGIIQVGKLQNYVDGISLDGFMSHISERASHIYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 129 - protein, 579 aa, Artificial sequence
  Synthetic polypeptide
MNEYISDFETQKDPDTGVMSVWAWSIVDVNDLSNIQYGNNIESWLSAIQGLPNGSLIGFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 130 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 131 - protein, 580 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKGWIDKWIEVKNTTEGARKANAKGMLNSLYGKFGTNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMPDRIKELVTFDNFEVGFSSYGKLLPKRTQGGVVLVDTMFTIK

SEQ ID NO: 132 - protein, 580 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEELRDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMPDRIKELVTFDNFEVGFSSYGKLLPKRTQGGVVLVDTMFTIK

SEQ ID NO: 133 - protein, 572 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPYGEPIYSEGAPRTNRPLYIASITFTAKLKPNHIPCIQIKKNLSFNPTQYLEEVKEPTTVVATNIDIELWKKHYDFKIYSWNGTFEFRGSHGFFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 134 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYSRLLPIGTPVFFEGKYKDDPIYPLYIQFITAQFELKKGKIPTIQIKNDKRFNPREYVTSTGCLMVNLYLTNVDLEMFYECYNIKEIQYIGGYKFIGRSGIFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 135 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 136 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISRMGQWYMIDICLGYKGKRKIHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 137 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLERNGFKWSNEGLPNTYNTIISKMGQWYMIDICIGYKGKRKLHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 138 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLERNGFKWSNEGLPNTYNTIISKMGQWYMIDICIGYKGKRKLHTVIYDSLKKLPFPVEKIAKDFQLTLKKGDIDIHKERPVGYEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 139 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 140 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 141 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 142 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 143 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 144 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 145 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 146 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 147 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 148 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 149 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 150 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 151 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 152 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 153 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 154 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 155 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYVPLASFVTAWGRYTTITTAQRCFDNIIYCDTDSIHLTGTEIPDVIKDIVDPKKLGYWEHESTFKRAKYLRQKTYIQDIYVKRVDGYLVECSPDEYTDIKFSVKCAGMPDRIKELVTFDNFEVGFSSYGKLLPKRTQGGVVLVDTMFTIK

SEQ ID NO: 156 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYVPLASFVTAWGRYTTITTAQRCFDNIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIK

SEQ ID NO: 157 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKRVDGYLVECSPDEYTDIKFSVKCAGMPDRIKELVTFDNFEVGFSSYGKLLPKRTQGGVVLVDTMFTIK

SEQ ID NO: 158 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYVPLASFVTAWGRYTTITTAQRCFDNIIYCDTDSIHLTGTEIPDVIKDIVDPKKLGYWEHESTFKRAKYLRQKTYIQDIYVKEVDGKLKECSPDEATDIKFSVKCAGMPDRIKELVTFDNFEVGFSSYGKLLPKRTQGGVVLVDTMFTIK

SEQ ID NO: 159 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYVPLASFVTAWGRYTTITTAQRCFDNIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIK

SEQ ID NO: 160 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKEVDGKLKECSPDEATDIKFSVKCAGMPDRIKELVTFDNFEVGFSSYGKLLPKRTQGGVVLVDTMFTIK

SEQ ID NO: 161 - protein, 618 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPTIQVKQNSLFIQNEYLENSVNKLGVDELIDLTLTNVDLDLFFEHYEILEIHFTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 162 - protein, 618 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPCIQVKQSSLFIQTEYLESSVNKLGVDELIELTLTNVDLDLFFEHYEILEIHFTYGYMFRGSCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 163 - protein, 618 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNIKVRFRLKERHIPTIQVKQNSLFIQNEYLENSVNKLGVDELIELTLTNVDLDLFFEHYEILEIHYTYGYMFRGSCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 164 - protein, 618 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQTEYLESSVNKLGVDELIELTLTNVDLDLFFEHYEILEIHYTYGYMFRGSCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 165 - protein, 618 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNIKVRFRLKERHIPTIQVKQNSLFIQTEYLENSVNKLGVDELIDLTVTNVDLDLFFEHYDILEIHFTYGYMFKASCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 166 - protein, 618 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQTEYLESSVNKLGVDELIDLTVTNVDLDLFFEHYDILEIHFTYGYMFKASCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 167 - protein, 618 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQTEYLENSVNKLGVDELIELTVTNVDLDLFFEHYEILEIHFTYGYMFRGSCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 168 - protein, 618 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQTEYLENSVNKLGVDELIELTVTNVDLDLFFEHYEILEIHFTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 169 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIDYPLYIQNIKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 170 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNIKVRFRLKERHIPTIQVKQNSLFIQNEYLENSVNKLGVDELIDLTVTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 171 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNIKVRFRLKERHIPTIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 172 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 173 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIDLTVTNVDLDLFFEHYDILEIHFTYGYMFKASCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 174 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPTIQVKQNSLFIQNEYLENSVNKLGVDELIDLTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 175 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPTIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 176 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPCIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 177 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQNEYLENSVNKLGVDELIELTVTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 178 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 179 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTVTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 180 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTVTNVDLDLFFEHYEILEIHFTYGYMFRASCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 181 - protein, 618 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 182 - protein, 580 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTVTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 183 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLERNGFKWSNEGLPNTYNTIISKMGQWYMIDICIGYKGKRKLHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 184 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYVKEVDGKLKECSPDEATDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 185 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYVPLASFVTAWGRYTTITTAQRCFDNIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 186 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEQHGFKWSNEGLPNTYNTIISKMGQWYMIDICFGYKGKRKLHTVIYDSLKKLPFPVKKIAKDFQLPLLKGDIDYHTERPVGHEITPEEYEYIKNDIEIIARALDIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYVKRVDGYLVECSPDEYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 187 - protein, 615 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPTIQVKQNSLFIQNEYLENSVNKLGVDELIDLTLTNVDLDLFFEHYEILEIHFTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 188 - protein, 615 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPCIQVKQSSLFIQTEYLESSVNKLGVDELIELTLTNVDLDLFFEHYEILEIHFTYGYMFRGSCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 189 - protein, 615 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNIKVRFRLKERHIPTIQVKQNSLFIQNEYLENSVNKLGVDELIELTLTNVDLDLFFEHYEILEIHYTYGYMFRGSCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 190 - protein, 615 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQTEYLESSVNKLGVDELIELTLTNVDLDLFFEHYEILEIHYTYGYMFRGSCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 191 - protein, 615 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNIKVRFRLKERHIPTIQVKQNSLFIQTEYLENSVNKLGVDELIDLTVTNVDLDLFFEHYDILEIHFTYGYMFKASCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 192 - protein, 615 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQTEYLESSVNKLGVDELIDLTVTNVDLDLFFEHYDILEIHFTYGYMFKASCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 193 - protein, 615 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQTEYLENSVNKLGVDELIELTVTNVDLDLFFEHYEILEIHFTYGYMFRGSCDMFKDFIDKFTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 194 - protein, 615 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIQYPLYIQNLKVRFRLKERHIPTIQVKQNSLFIQTEYLENSVNKLGVDELIELTVTNVDLDLFFEHYEILEIHFTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 195 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEKNGFKWSAEGLPNTYNTIISRMGQWYMIDICFGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 196 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEKNGFKWSAEGLPNTYNTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 197 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKLHTIIYDSLKKLPFPVEKIAKDFKLTLKKGDIDIHKERPIGYKITPDEYAYLKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 198 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEKNGFKWSAEGLPNTYNTIISRMGQWYMIDICFGYKGKRKLHTIIYDSLKKLPFPVEKIAKDFKLTLKKGDIDIHKERPIGYKITPDEYAYLKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 199 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEKNGFKWSAEGIPNTYNTIISRMGQWYMIDICFGYKGKRKLHTIIYDSLKKLPFPVEKIAKDFKLTLKKGDIDIHKERPIGYKITPDEYAYLKNDIQILAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 200 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLEQHGFKWSNEGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 201 - protein, 616 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 202 - protein, 616 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLLHNGYTWTKRPSKEGQFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 203 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLLHKGYECNESGRPKTFDTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 204 - protein, 616 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLLKHGYRWTKENPGVKEFTTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 205 - protein, 616 aa, Artificial sequence; identical to SEQ ID NO: 201
  Synthetic polypeptide

SEQ ID NO: 206 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLEKNGFKWTAEGEPNTYSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 207 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLLKNGFKWTAEGLPRTYSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 208 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLFKNGYKWTAEGLPNTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 209 - protein, 615 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLEKNGYKWTAEGLPKTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 210 - protein, 618 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLLRNGYVHTEEDRTNTPKEFTTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 211 - protein, 579 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLFRLGYEFTDEKAPQVKEFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 212 - protein, 618 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLLTDGWKWIPDKNDCANRTFTTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 213 - protein, 617 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLLENGFKHSRERALYSNEFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 214 - protein, 619 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLLGVAKWEYNDKPKARKAKTVETIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 215 - protein, 615 aa, Artificial sequence
  Synthetic polypeptide
MSRKMYSADFETTTKLDDCRVWSYGWMEVGNLDNYKIGNDIDEFMQWVMEIQSDLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 216 - protein, 615 aa, Artificial sequence
  Synthetic polypeptide
MSRKMYSCDFETTTKLDDCRVWAYGVMEVGNLDNYKIGNDIDEFMQWIMEIQSDLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 217 - protein, 615 aa, Artificial sequence
  Synthetic polypeptide
MSRKVFTADFETTTKLDDCRVWAYGWMEVGNLDNYKIGNSIDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 218 - protein, 615 aa, Artificial sequence
  Synthetic polypeptide
MSRKVYTADFETTTKLDDCRVWAYGWMEVGNLDNYKIGNSIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 219 - protein, 615 aa, Artificial sequence
  Synthetic polypeptide
MSRKMYTADFETTTKLDDCRVWAYGYMEVGNLDNYKIGNDIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 220 - protein, 615 aa, Artificial sequence
  Synthetic polypeptide
MSRKMYSADFETTTKLDDCRVWAYGYMEVGNLDNYKIGNSIDEFMQWIMEIQSDLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIKGHHHHHHHHHHGGGSGGGSGGGSGLNDFFEAQKIEWHE

SEQ ID NO: 221 - protein, 580 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 222 - protein, 580 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWNHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 223 - protein, 580 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWQHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 224 - protein, 580 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTRSEGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWAHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 225 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 226 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 227 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRFTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 228 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 229 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIQYPLYIQNIKVRFRLKERHIPTIQVKQSSLFIQNEYLESSVNKLGVDELIDLTLTNVDLDLFFEHYDILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRFTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 230 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAQDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSHYPAQMYVRPLPYGTPLFYEGEYKENIQYPLYIQNIKVRFRLKERHIPTIQVKQSSLFIQNEYLESSVNKLGVDELIDLTLTNVDLDLFFEHYDILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRFTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 231 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 232 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIQYPLYIQNIKVRFRLKERHIPTIQVKQSSLFIQNEYLESSVNKLGVDELIDLTLTNVDLDLFFEHYDILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRFTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 233 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAQDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYEGEYKENIQYPLYIQNIKVRFRLKERHIPTIQVKQSSLFIQNEYLESSVNKLGVDELIDLTLTNVDLDLFFEHYDILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRFTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 234 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 235 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 236 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 237 - protein, 578 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 238 - protein, 578 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 239 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIQHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRFTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 240 - protein, 578 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 241 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 242 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIQHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRFTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 243 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAQDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYEGEYKENIQHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRFTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 244 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAQDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYQGEYKENIQHPLYIQNLKVRFRLKERHIPCIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRFTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 245 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRFTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 246 - protein, 578 aa, Artificial sequence
  Synthetic polypeptide
MSRKRFSCDFETTTKLDDCRVWAYGYMEVGNLDNYKIGNSIDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIQHPLYIQNLKVRFRLKERHIPCIQVKQNSLFIQNEYLENSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRFTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFDNFKVGFSRKMKPKPVQVPGGVVLVDSVFTIK

SEQ ID NO: 247 - protein, 580 aa, Artificial sequence
  Synthetic polypeptide
MHKMSKKMFSCDFETTTKLDDCRVWAYGYMEVGNLDNYKIGNNIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 248 - protein, 580 aa, Artificial sequence
  Synthetic polypeptide
MHKMSRKMFSCDFETTTKLDDCRVWAYGYMEVGNLDNYKIGNSIDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 249 - protein, 577 aa, Artificial sequence
  Synthetic polypeptide
MSKKMFSCDFETTTKLDDCRVWAYGYMEVGNLDNYKIGNNIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 250 - protein, 577 aa, Artificial sequence
  Synthetic polypeptide
MSRKMFSCDFETTTKLDDCRVWAYGYMEVGNLDNYKIGNNIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 251 - protein, 577 aa, Artificial sequence
  Synthetic polypeptide
MSRKMFSCDFETTTKLDDCRVWAYGYMELGNLDNYKIGNNIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 252 - protein, 577 aa, Artificial sequence
  Synthetic polypeptide
MSRKMFSCDFETTTKLDDCRVWAYGYMELGNLDNYKIGNTIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 253 - protein, 577 aa, Artificial sequence
  Synthetic polypeptide
MSRKMFSCDFETTTKLDDCRVWAYGYMEVGNLDNYKIGNTIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 254 - protein, 577 aa, Artificial sequence
  Synthetic polypeptide
MSRKMFSCDFETTTKLDDCRVWAYGYMEIGNLDNYKIGNNIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 255 - protein, 577 aa, Artificial sequence
  Synthetic polypeptide
MSRKMFSCDFETTTKLDDCRVWAYGYMEIGNLDNYKIGNTIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 256 - protein, 577 aa, Artificial sequence
  Synthetic polypeptide
MSRKMFSCDFETTTKLDDCRVWAYGYMEVGNLDNYKIGNTLDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 257 - protein, 577 aa, Artificial sequence
  Synthetic polypeptide
MSRKMFSCDFETTTKLDDCRVWAYGYMEVGNLDNYKIGNSIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 258 - protein, 577 aa, Artificial sequence
  Synthetic polypeptide
MSRKMFSCDFETTTKLDDCRVWAYGYMELGNLDNYKIGNSIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 259 - protein, 580 aa, Artificial sequence
  Synthetic polypeptide
MHKMSRKRFSCDFETTTKLDDCRVWAYGYMEVGNLDNYKIGNNIDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 260 - protein, 577 aa, Artificial sequence
  Synthetic polypeptide
MSRKRFSCDFETTTKLDDCRVWAYGYMEVGNLDNYKIGNNIDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 261 - protein, 577 aa, Artificial sequence
  Synthetic polypeptide
MSRKRFSCDFETTTKLDDCRVWAYGYMEVGNLDNYKIGNNIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 262 - protein, 577 aa, Artificial sequence
  Synthetic polypeptide
MSRKRFSCDFETTTKLDDCRVWAYGYMEVGNLDNYKIGNTIDEFMQWIMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 263 - protein, 577 aa, Artificial sequence
  Synthetic polypeptide
MSRKMFSCDFETTTKLDDCRVWAYGYMEVGNLDNYKIGNNIDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 264 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 265 - protein, 581 aa, Artificial sequence
  Synthetic polypeptide
MHKMSRKRFSCDFETTTKLDDCRVWAYGYMEVGNLDNYKIGNNIDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 266 - protein, 581 aa, Artificial sequence
  Synthetic polypeptide
MHKMSRKRFSCDFETTTKLDDCRVWAYGYMEVGNLDNYKIGNNIDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 267 - protein, 581 aa, Artificial sequence
  Synthetic polypeptide
MHKMSRKRFSCDFETTTKLDDCRVWAYGYMEVGNLDNYKIGNNIDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 268 - protein, 581 aa, Artificial sequence
  Synthetic polypeptide
MHKMSRKRFSCDFETTTKLDDCRVWAYGYMEVGNLDNYKIGNNIDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 269 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 270 - protein, 581 aa, Artificial sequence
  Synthetic polypeptide
MHKMSKKMFSCDFETTTKLDDCRVWAYGYMEVGNLDNYKIGNNIDEFMQWIMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 271 - protein, 579 aa, Artificial sequence
  Synthetic polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDIIKDLVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 272 - protein, 579 aa, Artificial sequence
  Synthetic polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 273 - protein, 579 aa, Artificial sequence
  Synthetic polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVKGYLVQGSPDDYTDIKFSVKCAGMTDKIKEEVTFENFKVGFSRKMKPKPVQVPGGVVLVDSVFTIK

SEQ ID NO: 274 - protein, 579 aa, Artificial sequence
  Synthetic polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDIIKDIVHPKKLGYWEHESTFKRAKYLRQKTYIQDIYMKRVKGYLVQGSPDDYTDTKFSVKCAGMTDKIKEEVTFENFKVGFSRKMKPKPVQVPGGVVLVDSVFTIK

SEQ ID NO: 275 - protein, 579 aa, Artificial sequence
  Synthetic polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDIVHPKKLGYWEHESTFKRAKYLRQKTYIQDIYMKRVKGYLVQGSPDDYTDGKFSVKCAGMTDKIKEEVTFENFKVGFSRKMKPKPVQVPGGVVLVDSVFTIK

SEQ ID NO: 276 - protein, 579 aa, Artificial sequence
  Synthetic polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYIQDIYMKRVKGYLVQGSPDDYTDGKFSVKCAGMTDKIKEEVTFENFKVGFSRKMKPKPVQVPGGVVLVDSVFTIK

SEQ ID NO: 277 - protein, 579 aa, Artificial sequence
  Synthetic polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLESSVNKLGVDELIEITLTNVDVDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 278 - protein, 579 aa, Artificial sequence
  Synthetic polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKLHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLESSVNKLGVDELIEITLTNVDVDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 279 - protein, 579 aa, Artificial sequence
  Synthetic polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKQHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLESSVNKLGVDELIEITLTNVDVDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 280 - protein, 579 aa, Artificial sequence
  Synthetic polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTVTNVDLDLFFEHYEILEIHYTYGYMFRGSCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 281 - protein, 579 aa, Artificial sequence
  Synthetic polypeptide
MSRKRFSCDFETTTKLDDCRVWAYGYMEIGNLDNYKIGNSLDEFMQWAMEIQADLYFFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTVTNVDLDLFFEHYEILEIHYTYGYMFRSSCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 282 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 283 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 284 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 285 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 286 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 287 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDIIKDLVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 288 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 289 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVKGYLVQGSPDDYTDIKFSVKCAGMTDKIKEEVTFENFKVGFSRKMKPKPVQVPGGVVLVDSVFTIK

SEQ ID NO: 290 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDIIKDIVHPKKLGYWEHESTFKRAKYLRQKTYIQDIYMKRVKGYLVQGSPDDYTDTKFSVKCAGMTDKIKEEVTFENFKVGFSRKMKPKPVQVPGGVVLVDSVFTIK

SEQ ID NO: 291 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDIVHPKKLGYWEHESTFKRAKYLRQKTYIQDIYMKRVKGYLVQGSPDDYTDGKFSVKCAGMTDKIKEEVTFENFKVGFSRKMKPKPVQVPGGVVLVDSVFTIK

SEQ ID NO: 292 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYIQDIYMKRVKGYLVQGSPDDYTDGKFSVKCAGMTDKIKEEVTFENFKVGFSRKMKPKPVQVPGGVVLVDSVFTIK

SEQ ID NO: 293 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLESSVNKLGVDELIEITLTNVDVDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 294 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKLHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLESSVNKLGVDELIEITLTNVDVDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 295 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKQHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLESSVNKLGVDELIEITLTNVDVDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 296 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTVTNVDLDLFFEHYEILEIHYTYGYMFRGSCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 297 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTVTNVDLDLFFEHYEILEIHYTYGYMFRSSCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 298 - protein, 578 aa, Artificial sequence; identical to SEQ ID NO: 287
  Synthetic polypeptide

SEQ ID NO: 299 - protein, 578 aa, Artificial sequence; identical to SEQ ID NO: 288
  Synthetic polypeptide

SEQ ID NO: 300 - protein, 573 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 301 - protein, 575 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDVNSMYPAMMKNKLLPYGEPVMFKGEYKKNVEYPLYIQQVRCFFELKKDKIPCIQIKGNARFGQNEYLSTSGDEYVDLYVTNVDWELIKKHYDIFEEEFIGGFMFKGFIGFFDEYIDRFMEIKNSPDSSAEQSLQAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 302 - protein, 573 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKKNVEYPLYIQQVRCFFELKKDKIPCIQIKGNARFGQNEYLSTSGDEYVDLYVTNVDWELIKKHYDIFEEEFIGGFMFKGFIGFFDDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 303 - protein, 573 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYSRPLPYGAPIVFQGKYEKDEQYPLYIQRIRFEFELKEGYIPTIQIKKNPFFKGNEYLKNSGVEPVELYLTNVDLELIQEHYELYNVEYIDGFKFREKTGLFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 304 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 305 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKPNNDYPLYIQNIKVRFRLKEGYIPTIQVKQSSLFIQNEYLDSSVNKLGVDELIDLTLTNVDLELFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 306 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKEGYIPTIQIKRSRFYKGNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 307 - protein, 573 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKEGYIPTIQIKRSRFYKGNEYLKSSGGELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 308 - protein, 573 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKEGYIPTIQIKRSRFYKGNEYLKSSGGELIELTLTNVDLELMKEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 309 - protein, 573 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRLLPYGEPLFYEGEYKENIDHPLYIQNLKVRFRLKEGYIPTIQIKRSRFYKGNEYLKSSGGELIELTLTNVDLELMKEHYEILEIHYTYGYMFKATTGMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 310 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRLLPYGEPLFYEGEYKENIDHPLYIQNLKVRFRLKERHIPCIQVKQSSLFIQNEYLESSVNKLGVDELIELTLTNVDLDLFFEHYEILEIHYTYGYMFKATTGMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 311 - protein, 573 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRLLPYGEPLFYEGEYKENIDHPLYIQNLKVRFRLKEGYIPTIQIKRSRFYKGNEYLKSSGGELIELTLTNVDLDLFFEHYEILEIHYTYGYMFKATTGMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 312 - protein, 573 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKRSRLFIQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 313 - protein, 573 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKRSRLFKQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 314 - protein, 573 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKRSRLYKQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 315 - protein, 573 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKRSRFYKGNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 316 - protein, 573 aa, Artificial sequence; identical to SEQ ID NO: 313
  Synthetic polypeptide

SEQ ID NO: 317 - protein, 574 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGLPVPFSGEYEYDETHPLFIQHIKCGFELKDGHIPTIQIKKNFRFADNEYLHSSEGNILDLHVTNVDLALIKEHYTLYEEEYLQGYKFKQVTGLFKNYIDYWSDKKINAEDPAIRQMAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 318 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 319 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 320 - protein, 573 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 321 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 322 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 323 - protein, 575 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDVNSMYPAMMKNKLLPYGEPVMFKGEYKKNVEYPLYIQQVRCFFELKKDKIPCIQIKGNARFGQNEYLSTSGDEYVDLYVTNVDWELIKKHYDIFEEEFIGGFMFKGFIGFFDEYIDRFMEIKNSPDSSAEQSLQAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 324 - protein, 573 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKRSRLFIQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 325 - protein, 573 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKRSRLFKQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 326 - protein, 573 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKRSRLYKQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 327 - protein, 573 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKRSRFYKGNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 328 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKRSRLFKQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 329 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKEGYIPTIQIKRSRFYKGNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 330 - protein, 573 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKEGYIPTIQIKRSRFYKGNEYLKSSGGELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 331 - protein, 573 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKEGYIPTIQIKRSRFYKGNEYLKSSGGELIELTLTNVDLELMKEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 332 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 333 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 334 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 335 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 336 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKEGYIPTIQIKRSRFYKGNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 337 - protein, 573 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKEGYIPTIQIKRSRFYKGNEYLKSSGGELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 338 - protein, 573 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKEGYIPTIQIKRSRFYKGNEYLKSSGGELIELTLTNVDLELMKEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 339 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDIIKDLVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 340 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 341 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVKGYLVQGSPDDYTDIKFSVKCAGMTDKIKEEVTFENFKVGFSRKMKPKPVQVPGGVVLVDSVFTIK

SEQ ID NO: 342 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDIIKDIVHPKKLGYWEHESTFKRAKYLRQKTYIQDIYMKRVKGYLVQGSPDDYTDTKFSVKCAGMTDKIKEEVTFENFKVGFSRKMKPKPVQVPGGVVLVDSVFTIK

SEQ ID NO: 343 - protein, 572 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVKNKLLPYGEPVMFKGEYKKNVEYPLYIQQVRCFFELKKDKIPCIQIKGNARFGQNEYLSTSGDEYVDLYVTNVDWELIKKHYDIFEEEFIGGFMFKGMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 344 - protein, 576 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYSRLLPYGEPIVFEGKYVWDEDYPLHIQHIRCEFELKEGYIPTIQIKRSRFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 345 - protein, 580 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 346 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDHPLHIQHLRCEFELKEGYIPCIQIKQSLFYKGNEYLKSSGGEIAELWLSNVDLELMKEHYELYNVEYISGLKFRATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 347 - protein, 580 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 348 - protein, 572 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 349 - protein, 576 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 350 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 351 - protein, 572 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 352 - protein, 573 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 353 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 354 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 355 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 356 - protein, 575 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYSRLLPYGEPIVFEGKYVWDEDYPLHIQHIRCEFELKEGYIPTIQIKQSLFYKGNEYLKSSGGEIADLWLSNVDLELMKEHYDLYNVEYISGLKFKATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 357 - protein, 577 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 358 - protein, 580 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 359 - protein, 577 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 360 - protein, 575 aa, Artificial sequence
  Synthetic polypeptide
MKHMPRKMYSCDFETTTKVEDCRVWAYGYMNIEDHSEYKIGNSLDEFMAWVLKVQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYSRLLPYGEPIVFEGKYVWDEDHPLHIQHLRCEFELKEGYIPCIQIKQSLFYKGNEYLKSSGGEIAELWLSNVDLELMKEHYELYNVEYISGLKFRATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 361 - protein, 575 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYSRLLPYGEPIVFEGKYVWDEDHPLHIQHLRCEFELKEGYIPCIQIKQSLFYKGNEYLKSSGGEIAELWLSNVDLELMKEHYELYNVEYISGLKFRATTGLFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 362 - protein, 580 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 363 - protein, 577 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 364 - protein, 580 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 365 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQNSLFIQNEYLENSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 366 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 367 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQSSLFIQNEYLENSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 368 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQNSLFIQNEYLENSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 369 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 370 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 371 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICVGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 372 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 373 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKQHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYVQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 374 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIEITLTNVDVDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 375 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYVQNLKVRFRLKERHIPCIQVKQSSLFIQNEYLESSVNKLGVDELIEITLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 376 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKQHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDVDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 377 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTVTNVDLDLFFEHYEILEIHYTYGYMFRGSCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 378 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTVTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 379 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRGSCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 380 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTVTNVDLDLFFEHYEILEIHYTYGYMFRGSCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 381 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVDGYLVQGSPDDYTDIKFSVKCAGMTDKIKEEVTFENFKVGFSRKMKPKPVQVPGGVVLVDSVFTIK

SEQ ID NO: 382 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKLSVKCAGMTDKIKEEVTFENFKVGFSRKMKPKPVQVPGGVVLVDSVFTIK

SEQ ID NO: 383 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYQGEYKENIDHPLYVQNLKVRFRLKERHIPCIQVKQNSLFIQNEYLENSVNKLGVDELIEITLTNVDVDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 384 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 385 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 386 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 387 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEKNGFKWSAEGLPNTYNTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 388 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 389 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLEKNGFKWSAEGLPNTYNTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 390 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIVNWLEKNGFKWSAEGLPNTYNTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 391 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 392 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 393 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPTIQVKQNSLFIQNEYLENSVNKLGVDELIDLTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 394 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIVNWLEKNGFKWSAEGLPNTYNTIISRMGQWYMIDICIGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 395 - protein, 578 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 396 - protein, 577 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 397 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 398 - protein, 577 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 399 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 400 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 401 - protein, 578 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 402 - protein, 578 aa, Artificial sequence
  Synthetic polypeptide
MSRKRFSCDFETTTKLDDCRVWAYGYMEIGNLDNYKIGNSLDEFMQWAMEIQADLYFHDLKFDGAFIINWLFRNGFKWCKDAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 403 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 404 - protein, 577 aa, Artificial sequence
  Synthetic polypeptide
MSRKMFSCDFETTTKLDDCRVWAYGYMEIGNLDNYKIGNSLDEFMQWVMEIQADLYFHDLKFDGAFIINWLERNGFKWSADGLPNTYNTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDANSHYPAQMYVRPLPYGTPLFYQGEYKENIDHPLYIQNLKVRFRLKERHIPTIQVKQNSLFIQNEYLENSVNKLGVDELIDLTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTEIPDVIKDIVDPKKLGYWEHESTFKRAKYLRQKTYIQDIYMKRVKGYLVQGSPDDYTDIKFSVKCAGMTDKIKKEVTFENFKVGFSRKMKPKPVQVPGGVVLVDETFTIK

SEQ ID NO: 405 - protein, 577 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 406 - protein, 577 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 407 - protein, 581 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 408 - protein, 580 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 409 - protein, 580 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 410 - protein, 577 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 411 - protein, 577 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 412 - protein, 581 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 413 - protein, 580 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIVNWLEKNGFKWSAEGLPNTYNTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 414 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 415 - protein, 581 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 416 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 417 - protein, 581 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 418 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 419 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 420 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 421 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 422 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 423 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 424 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 425 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 426 - protein, 581 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 427 - protein, 581 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 428 - protein, 581 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 429 - protein, 581 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 430 - protein, 577 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 431 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 432 - protein, 580 aa, Artificial sequence
  Synthetic polypeptide
MKHMPRKRYSCDFETTTKLDDCRVWAYGYMEIGNLDNYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 433 - protein, 580 aa, Artificial sequence
  Synthetic polypeptide
MKHMSRKRFSCDFETTTKLDDCRVWAYGYMEIGNLDNYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 434 - protein, 581 aa, Artificial sequence
  Synthetic polypeptide
MKHMPRKRYSCDFETTTKLDDCRVWAYGYMEIGNLDNYKIGNSLDEFMAWALKVQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKVPDAIKDLVHPKKLGYWEHESTFKRAKYLRQKTYVQDIYMKRVRGYLVQGSPDDYTDIKFSVKCAGMTDKIKEEVTFENFKVGFSRKMKPKPVQVPGGVVLVDSVFTIK

SEQ ID NO: 435 - protein, 580 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 436 - protein, 580 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 437 - protein, 580 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLAVFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 438 - protein, 580 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 439 - protein, 580 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLAVFVTAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 440 - protein, 580 aa, Artificial sequence
  Synthetic polypeptide
MKHMSRKRYSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 441 - protein, 577 aa, Artificial sequence
  Synthetic polypeptide
MPRKRYSCDFETTTKVEDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 442 - protein, 577 aa, Artificial sequence
  Synthetic polypeptide
MSRKRFSCDFETTTKLDDCRVWAYGYMNIEDHSEYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 443 - protein, 577 aa, Artificial sequence
  Synthetic polypeptide
MSRKRFSCDFETTTKLDDCRVWAYGYMEIGNLDNYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 444 - protein, 577 aa, Artificial sequence
  Synthetic polypeptide
MSRKRFSCDFETTTKLDDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 445 - protein, 577 aa, Artificial sequence
  Synthetic polypeptide
MPRKRYSCDFETTTKVEDCRVWAYGYMEIGNLDNYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 446 - protein, 577 aa, Artificial sequence
  Synthetic polypeptide
MPRKRYSCDFETTTKVEDCRVWAYGYMNIEDHSEYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 447 - protein, 580 aa, Artificial sequence
  Synthetic polypeptide
MKHMPRKRYSCDFETTTKLDDCRVWAYGYMEIGNLSEYKIGNSLDEFMQWAMKIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 448 - protein, 580 aa, Artificial sequence
  Synthetic polypeptide
MKHMPRKRYSCDFETTTKLDDCRVWAYGYMEIGNHSEYKIGNSLDEFMQWAMKIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 449 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 450 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFGTNPDITGKVPYMGEDGIVRLTLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMPDRIKELVTFDNFEVGFSSYGKLLPKRTQGGVVLVDTMFTIK

SEQ ID NO: 451 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFGTNPDITGKVPYMGEDGIVRLTLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 452 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFGTNPDITGKVPYMGEDGIVRLTLGEEETKDPVYTPLASFVTAWGRYTTITTAQACYDRIIYCDTDSIHLTGTKIPDVIKDIVHPKKLGYWEHESTFKRAKYLRQKTYIQDIYMKRVKGYLVQGSPDDYTDIKFSVKCAGMPDRIKELVTFDNFEVGFSSYGKLLPKRTQGGVVLVDTMFTIK

SEQ ID NO: 453 - protein, 577 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMPDRIKELVTFDNFEVGFSSYGKLLPKRTQGGVVLVDTMFTIK

SEQ ID NO: 454 - protein, 580 aa, Artificial sequence
  Synthetic polypeptide
MKHMPRKRYSCDFETTTKVEDCRVWAYGYMNIEDHSEYKIGNSLDEFMAWALKVQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMPDRIKELVTFDNFEVGFSSYGKLLPKRTQGGVVLVDTMFTIK

SEQ ID NO: 455 - protein, 577 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 456 - protein, 577 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLERNGFKWSADGLPNTYNTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFGTNPDITGKVPYMGEDGIVRLTLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMPDRIKELVTFDNFEVGFSSYGKLLPKRTQGGVVLVDTMFTIK

SEQ ID NO: 457 - protein, 573 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKEGYIPTIQIKQSLFYKGNEYLKSSGGELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 458 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 459 - protein, 573 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKRSRLFIQNEYLESSVNELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 460 - protein, 573 aa, Artificial sequence
  Synthetic polypeptide
MSRKMFSCDFETTTKLDDCRVWAYGYMEIGNLDNYKIGNSLDEFMQWVMEIQADLYFHNLKFDGAFIINWLFKNGFKWCKEAKEERTFSTIISRMGQWYMIDICLGYKGKRKIHTVIYDSLKKLPFPVKKIAQDFKLTVKKGDIDYHKERPVGYKITPEEYAYIKNDIQIIAEALLIQFKQGLDRMTAGSDSLKGFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKEGYIPTIQIKRSRFYKGNEYLKSSGGELIELTLTNVDLELMKEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 461 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 462 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSHYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 463 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 464 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDVNSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWFYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 465 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDVNSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 466 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 467 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIINWLFKNGFKWCKEAKEERTFSTIISRMGQWYMIDICLGYKGKRKIHTVIYDSLKKLPFPVEKIAKDFKLTVKKGDIDIHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDANSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPMGVFITAWGRYTTITAAQACYDRIIYCDTDSIHLTGTKIPDVIKDIVHPKKLGYWEHESTFKRAKYLRQKTYIQDIYMKRVKGYLVQGSPDDYTDIKFSVKCAGMTDKIKEEVTFENFKVGFSRKMKPKPVQVPGGVVLVDSVFTIK

SEQ ID NO: 468 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 469 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 470 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 471 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 472 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGSLGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 473 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGILGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 474 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGALGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 475 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKEDGALGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 476 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKEDGIVRLTLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 477 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKEDGIVGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 478 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGIVGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 479 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 480 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGAVGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 481 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 482 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPKQVPGGVVLVDSVFTIK

SEQ ID NO: 483 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPVQVPGGVVLVDSVFTIK

SEQ ID NO: 484 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPVQTPGGVVLVDSVFTIK

SEQ ID NO: 485 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFENFKVGFSRKMKPKPVQTPGGVVLVDSVFTIK

SEQ ID NO: 486 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDTIKEEVTFDNFKVGFSRKMKPKPKQVPGGVVLVDSVFTIK

SEQ ID NO: 487 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDTIKEEVTFDNFKVGFSRKMKPKPVQVPGGVVLVDSVFTIK

SEQ ID NO: 488 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDTIKEEVTFDNFKVGFSRKMKPKPVQTPGGVVLVDSVFTIK

SEQ ID NO: 489 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPIGYKITPEEYAYIKNDIQIIAEALLIQFKQGLDRMTAGSDSLKDFKDILTTKKFKKVFPTLSLGLDKEIRKAYRGGFTWVNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 490 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDILTTKKFKKVFPTLSLGLDKEIRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 491 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDILTTKKFKKVFPTLSLGLDKEIRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 492 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYQGEYKENIDHPLYIQNLKVRFRLKERHIPCIQVKQNSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 493 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKDDGALGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 494 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 495 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPKQVPGGVVLVDSVFTIK

SEQ ID NO: 496 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPVQTPGGVVLVDSVFTIK

SEQ ID NO: 497 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDILTTKKFKKVFPTLSLGLDKEIRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPVQTPGGVVLVDSVFTIK

SEQ ID NO: 498 - protein, 578 aa, Artificial sequence
  Synthetic polypeptide
MSRKRFSCDFETTTKLDDCRVWAYGYMEIGNLDNYKIGNSLDEFMQWAMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDILTTKKFKKVFPTLSLGLDKEIRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPVQTPGGVVLVDSVFTIK

SEQ ID NO: 499 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTLISRMGQWYMIDICIGYKGKRKIHTVIYDSLKKLPFPVKKIAQDFKLTVKKGDIDYHKERPIGYKITPEEYAYIKNDIQIIAEALLIQFKQGLDRMTAGSDSLKDFKDILTTKKFKKVFPTLSLGLDKEIRKAYRGGFTWLNDRFKGKEIGEGMVFDINSAYPAQMYVRPLPYGTPLFYEGEYKENIDHPLYIQNLKVRFRLKERHIPCIQVKQSSLFIQNEYLESSVNKLGVDELIELTLTNVDLDLFFEHYEILEIHYTYGYMFRASCDMFKDFIDKWTYIKTTSYGAIKQLAKLMLNSLYGKFASNPDVTGKVPYLKENGIVGFRVGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDRIKEEVTFDNFKVGFSRKMKPKPVQTPGGVVLVDSVFTIK

SEQ ID NO: 500 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGSLGFRVGDEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 501 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKDDGSLGFRVGDEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDTIKEEVTFDNFAVGFSRKMKPKPVQVPGGVVLVDSVFTIK

SEQ ID NO: 502 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLAVFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 503 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKKLTTIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 504 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKQRTIFYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 505 - protein, 578 aa, Artificial sequence; identical to SEQ ID NO: 504
  Synthetic polypeptide

SEQ ID NO: 506 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKNHVVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 507 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKNHVVFYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 508 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKGTTQIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 509 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKFRVEIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 510 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKFRVEFYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDRFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 511 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNDKYKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 512 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNPKYKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 513 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNPKFKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 514 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLNPRYKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 515 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLDPKYKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 516 - protein, 578 aa, Artificial sequence
  Synthetic polypeptide
MSRKMFSCDFETTTKLDDCRVWAYGYMEIGNLDNYKIGNSLDEFMQWVMEIQADLYFHNLKFDGAFIVNWLFKNGFKWCKEAKEERTFSTIISRMGQWYMIDICIGYKGKRKIHTVIYDSLKKLPFPVKKIAQDFKLTVKKGDIDYHKERPVGYKITPEEYAYIKNDIQIIAEALLIQFKQGLDRMTAGSDSLKDFKDIITTKKFKKVFPTLSLGLDKEVRKAYRGGFTWLDPRYKGKEIGEGMVFDINSAYPAQMYVRPLPYGTPLFYEGEYKENIDYPLYIQNIKVRFRLKERHIPTIQVKQSSLFIQNEYLESSVNKLGVDELIDLTLTNVDLDLFFEHYDILEIHYTYGYMFKASCDMFKDFIDKWTYIKTTSYGAIKQLAKLMLNSLYGKFASNPDVTGKVPYLKENGALGFRLGEEETKDPVYTPLASFVTAWGRYTTITTAQACYDRIIYCDTDSIHLTGTKIPDVIKDIVHPKKLGYWEHESTFKRAKYLRQKTYIQDIYMKRVRGYLVQGSPDDYTDIKFSVKCAGMTDKIKEEVTFENFKVGFSRKMKPKPVQVPGGVVLVDSVFTIK

SEQ ID NO: 517 - protein, 27 aa, Artificial sequence
  Synthetic polypeptide
GGGSGGGSGGGSGLNDFFEAQKIEWHE

SEQ ID NO: 518 - protein, 53 aa, Bacillus phage phi29
DLYFHNLKFDGAFIINWLERNGFKWSADGLPNTYNTIISRMGQWYMIDICLGY

SEQ ID NO: 519 - protein, 53 aa, Bacteriophage M2Y
DLYFHDLKFDGAFIVNWLEQHGFKWSNEGLPNTYNTIISKMGQWYMIDICFGY

SEQ ID NO: 520 - protein, 54 aa, Lucilia cuprina
RLYFHDLKFDGSFIVNWLLHNGYTWTKRPSKEGQFSTLISKMGQWYGITICSGR

SEQ ID NO: 521 - protein, 54 aa, Enterococcus faecium
DIYFHDEKFDGEFMLSWLFKNGFKWCKEAKEERTFSTLISNMGQWYALEICWNV

SEQ ID NO: 522 - protein, 56 aa, Bacillus phage GA-1
DIYFHNLKFDGSFILPWWLRNGYVHTEEDRTNTPKEFTTTISGMGQWYAVDVCINT

SEQ ID NO: 523 - protein, 53 aa, Bacillus phage VMY22
DLYFHDLRYDGEFIVNWLLHKGYECNESGRPKTFDTVISKGGQWYKIAIHHEG

SEQ ID NO: 524 - protein, 54 aa, Actinomyces phage AV-1
HIYFHNLAFDGTFILDWLLKHGYRWTKENPGVKEFTSLISRMGKYYSITVVFET

SEQ ID NO: 525 - protein, 55 aa, Globodera sp.
ITFFHNLKFDGAFILDRLFRLGYEFTDEKAPQVKEFSTLISKMGQFYSIKVRWEN

SEQ ID NO: 526 - protein, 56 aa, Lynx pardinus
RVYFHNLKFDGKFILHKILTDGWKWIPDKNDCANRTFTTLISDMSQFYSIKLWFDE

SEQ ID NO: 527 - protein, 55 aa, Candidatus Moranbacteria
EVFFHNLKYDGDFIVKFLLENGFKHSRERALYSNEFSTLISDTGTWYEIKICFHA

SEQ ID NO: 528 - protein, 57 aa, Eggerthella sp.
LIGFHNLKFDGSYILSYLLGVAKWEYNDKPKARKAKTVECLISSIGVHYNYRINFTK

SEQ ID NO: 529 - protein, 12 aa, Bacillus phage phi29
NGFKWSADGLPN

SEQ ID NO: 530 - protein, 12 aa, Bacteriophage M2Y
HGFKWSNEGLPN

SEQ ID NO: 531 - protein, 13 aa, Lucilia cuprina
NGYTWTKRPSKEG

SEQ ID NO: 532 - protein, 13 aa, Enterococcus faecium
NGFKWCKEAKEER

SEQ ID NO: 533 - protein, 15 aa, Bacillus phage GA-1
NGYVHTEEDRTNTPK

SEQ ID NO: 534 - protein, 12 aa, Bacillus phage VMY22
KGYECNESGRPK

SEQ ID NO: 535 - protein, 13 aa, Actinomyces phage AV-1
HGYRWTKENPGVK

SEQ ID NO: 536 - protein, 14 aa, Globodera sp.
LGYEFTDEKAPQVK

SEQ ID NO: 537 - protein, 15 aa, Lynx pardinus
DGWKWIPDKNDCANR

SEQ ID NO: 538 - protein, 14 aa, Eggerthella sp.
NGFKHSRERALYSN

SEQ ID NO: 539 - protein, 16 aa, Eggerthella sp.
VAKWEYNDKPKARKAK

deletion, or substitution at a position corresponding to a position selected from positions: M8, V51, N62, I71, L107, K131, K135, L142, G197, Y224, E239, V250, L253, Y281, I288, T301, R306, R308, D325, D341, K354, T368, E375, A437, A444, E466, D476, A484, E508, D510, K512, E515, K539, D570, and T571 in SEQ ID NO: 1.

11. The recombinant polymerizing enzyme chimera of claim 10, comprising one or more amino acid substitutions selected from M8R, V51A, N62D, I71V, L107I, K131E, K135Q, L142K, G197D, Y224K, E239G, V250A, V250I, L253A, L253H, Y281H, I288L, T301C, R306Q, R308L, D325E, D341E, K354R, T368F, E375Y, A437G, A444T, E466K, D476H, A484E, E508R, D510K, D510R, K512Y, E515Q, K539E, D570S, and T571V in SEQ ID NO: 1.

12. The recombinant polymerizing enzyme chimera of claim 1, comprising one or more amino acid substitutions at positions corresponding to I71, L107, K135, L142, G197, Y224, E239, V250, L253, E375, A437, A444, E466, D476, A484, E508, D510, K512, E515, K539, D570, and T571 in SEQ ID NO: 1.

13. The recombinant polymerizing enzyme chimera of claim 12, wherein the one or more amino acid substitutions are selected from I71V, L107I, K135Q, L142K, G197V, Y224K, E239G, V250I, L253A, E375Y, A437G, A444V, E466K, D476H, A484E, E508R, D510R, K512Y, E515Q, K539E, D570S, and T571V in SEQ ID NO: 1.

14. The recombinant polymerizing enzyme chimera of claim 1, comprising one or more amino acid substitutions at positions corresponding to K131, K135, L142, Y148, Y224, E239, V250, L253, R306, R308, E375, A437, E466, D476, A484, E508, D510, K512, E515, K539, D570, and T571 in SEQ ID NO: 1.

15. The recombinant polymerizing enzyme chimera of claim 14, wherein the one or more amino acid substitutions are selected from K131E, K135Q, L142K, Y148I, Y224K, E239G, V250A, V250I, L253A, L253H, R306Q, R308L, E375Y, A437G, E466K, D476H, A484E, E508R, D510K, D510R, K512Y, E515Q, K539E, D570E, D570S, and T571V in SEQ ID NO: 1.

16. The recombinant polymerizing enzyme chimera of claim 14, wherein the one or more amino acid substitutions are selected from K131E, L142K, Y148I, Y224K, E239G, V250A, L253H, E375Y, A437G, A484E, E508R, D510K, K512Y, E515Q, and D570E in SEQ ID NO: 1.

17. The recombinant polymerizing enzyme chimera of claim 1, wherein at least one or more of the segments from SEQ ID NO: 5 comprises an exonuclease region, a palm region, a TPR1 region, a fingers region, a TPR2 region, a thumb region, or a portion of any one thereof, and optionally comprising one or more flanking amino acids.

18. A recombinant polymerizing enzyme having an amino acid sequence that is at least 80% identical to SEQ ID NO: 1 and comprising:
a) amino acids 445-449 from SEQ ID NO: 5 in place of amino acids corresponding to amino acids 429-433 in SEQ ID NO: 1;
b) amino acids 271-375 from SEQ ID NO: 5 in place of amino acids corresponding to amino acids 260-359 in SEQ ID NO: 1; and/or
c) amino acids 72-89 from SEQ ID NO: 5 in place of amino acids corresponding to amino acids 75-91 in SEQ ID NO: 1.

19. The recombinant polymerizing enzyme of claim 18, comprising:
a) at least one amino acid insertion, deletion, or substitution at a position corresponding to a position selected from positions: M8, V51, N62, I71, L107, K131, K135, L142, G197, Y224, E239, V250, L253, Y281, I288, T301, R306, R308, D325, D341, K354, T368, E375, A437, A444, E466, D476, A484, E508, D510, K512, E515, K539, D570, and T571 in SEQ ID NO: 1;
b) one or more amino acid substitutions at positions corresponding to I71, L107, K135, L142, G197, Y224, E239, V250, L253, E375, A437, A444, E466, D476, A484, E508, D510, K512, E515, K539, D570, and T571 in SEQ ID NO: 1; and/or
c) one or more amino acid substitutions at positions corresponding to K131, K135, L142, Y148, Y224, E239, V250, L253, R306, R308, E375, A437, E466, D476, A484, E508, D510, K512, E515, K539, D570, and T571 in SEQ ID NO: 1.

20. The recombinant polymerizing enzyme of claim 18, further comprising amino acids 1-51 from SEQ ID NO: 2 in place of amino acids corresponding to amino acids 1-54 of SEQ ID NO: 1.

21. The recombinant polymerizing enzyme of claim 18, comprising two or more corresponding amino acid segments selected from the group consisting of: amino acids 1-51 from SEQ ID NO: 2, amino acids 271-375 from SEQ ID NO: 5, amino acids 72-89 from SEQ ID NO: 5, and amino acids 445-449 from SEQ ID NO: 5.

22. The recombinant polymerizing enzyme of claim 18 having a sequence selected from the group consisting of: SEQ ID NOs: 107, 109, 120, 126, 127, 128, 129, 130, 131, 132, 135, 136, 137, 138, 139, 140, 141, 142, 143, 144, 145, 146, 147, 148, 149, 150, 151, 152, 153, 154, 184, 186, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 231, 234, 235, 236, 237, 238, 239, 240, 241, 247, 248, 249, 250, 251, 252, 253, 254, 255, 256, 257, 258, 259, 260, 261, 262, 263, 282, 283, 284, 285, 286, 300, 302, 303, 304, 305, 306, 307, 308, 309, 310, 311, 312, 313, 314, 315, 316, 317, 320, 324, 325, 326, 327, 328, 329, 330, 331, 332, 333, 334, 335, 336, 337, 338, 343, 344, 345, 349, 352, 353, 355, 357, 358, 359, 362, 363, 364, 381, 384, 385, 390, 391, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 453, 454, 455, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 500, 501, 502, 503, 504, 505, 506, 507, 508, 509, 510, 511, 512, 513, 514, 515, and 516.

23. The recombinant polymerizing enzyme of claim 18, further comprising a purification tag.

24. The recombinant polymerizing enzyme of claim 18, further comprising a coupling group, optionally wherein the coupling group is a biotinylation sequence.

25. The recombinant polymerizing enzyme of claim 18 immobilized on a surface.

26. An isolated nucleic acid molecule that encodes the recombinant polymerizing enzyme of claim 18.

27. A composition comprising the recombinant polymerizing enzyme of claim 18.

28. A method of sequencing a nucleic acid, the method comprising contacting the recombinant polymerizing enzyme of claim 18 with a sequencing reaction mixture.

29. A recombinant polymerizing enzyme comprising SEQ ID NO: 416.

* * * * *

UNITED STATES PATENT AND TRADEMARK OFFICE
CERTIFICATE OF CORRECTION

PATENT NO. : 11,312,944 B2
APPLICATION NO. : 15/846967
DATED : April 26, 2022
INVENTOR(S) : Brian Reed et al.

It is certified that error appears in the above-identified patent and that said Letters Patent is hereby corrected as shown below:

In the Claims

Column 188, Line 30, in Claim 5, "ploymerizing" should read --polymerizing--

Column 189, Line 2, in Claim 10, "171" should read --I71--

Column 189, Line 4, in Claim 10, "1288" should read --I288--

Column 189, Line 17, in Claim 12, "171" should read --I71--

Column 190, Line 1, in Claim 19, "171" should read --I71--

Column 190, Line 3, in Claim 19, "1288" should read --I288--

Column 190, Line 7, in Claim 19, "171" should read --I71--

Signed and Sealed this
Third Day of September, 2024

Katherine Kelly Vidal
*Director of the United States Patent and Trademark Office*